United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 23

SEQ ID NO: 25455 - DNA, 5498 bp, Homo sapiens
ctggtttcacgcgtctcgggagccaggttggcggtgcgatgaggcgcagcaaagcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttg

SEQ ID NO: 25456 - DNA, 6931 bp, Homo sapiens
caagacaccctcagagcacagggtgctgccaagagcccggccgagtgcagctcgagcgccgacgtcgccaaggatacacagtgctgacgcagtacacaagtgcgtcacagtggtcctccgccggctacgtcagtggctttcaggcgctttcctgttggaattggcgactgctgcggggctgagcgctggtttcacgcgtctcgggagccaggttggcggtgcgatgaggcgcagcaaagcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaa

SEQ ID NO: 25457 - DNA, 6695 bp, Homo sapiens
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagt

SEQ ID NO: 25458 - DNA, 2453 bp, Homo sapiens
tatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcat

SEQ ID NO: 25459 - DNA, 5383 bp, Homo sapiens
aggcgctttcctcttggaattggcgactgctgcggggctgagcgctggtctcacgcatctcgggagccaggttggtggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaagctgaacgtggttttgttttaaattctactttttaa

SEQ ID NO: 25460 - DNA, 736 bp, Homo sapiens
tagttctcgggggcttgggcacccgggtgctgtatcggcgggtttcttcccatctcctggacatttactttatatgctgcggcggaggtcatacctccttggcctggaggaacccagtggggactgacgcagctccgggtgagctttggcggctgcgtcgagtgacaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaagttt

SEQ ID NO: 25461 - DNA, 3599 bp, Homo sapiens
attcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtgaggaataaaatgcttcccgttcttctggatgggcatcctatcttcgtagttggtttggacttcgataggttgatggaaggaatgtttttattaaccaaataaaatctatttac

SEQ ID NO: 25462 - DNA, 1136 bp, Homo sapiens
gtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtcttcaagaaacctccatacccaagaaaaaatagaaagcaacgatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagcataacaacgattacatagcatttacattatattagggattgcacaagagaaggtatgtaggttatatgcaaatactgcaccattttacataagggacttgagaagcatggattttggtag

SEQ ID NO: 25463 - DNA, 5594 bp, Homo sapiens
gctttcaggcgctttcctcttggaattggcgactgctgcggggctgagcgctggtctcacgcatctcgggagccaggttggtggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtgaggaataaaatgcttcccgttcttctggatgggcatcctatcttcgtagttggtttggacttcgataggttgatggaaggaatgtttttattaaccaaataaaatctatttacaaaaatggttcatgtgtattaccatcattcttttgtcaaaaagtgtgtatatgtttgcatttacatatatttgtacatctatatgacagatgtattttaaaagtttcaacttgaagtaaaagta

SEQ ID NO: 25464 - DNA, 5383 bp, Homo sapiens
aggcgctttcctgttggaattggcgactgctgcggggctgagcgctggtttcacgcgtctcgggagccaggttggtggcgcgatgagttgcagcaaggcctacggggagcggtacgtcgcctccgtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactgtgatttaagggaagatgctttggatgatagtgtcagtagtagctcagtacatgcttctccattggcaagtagccctgtgagaaaaaatcttttccattttggtgagtcaacaacaggatctaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaaaaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacacaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaagctgaacgtggttttgttttaaattctactttttaa

SEQ ID NO: 25465 - DNA, 3599 bp, Homo sapiens
attcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaaggtgaggaataaaatgcttcccgttcttctggatgggcatcctatcttcgtagttggtttggacttcgataggttgatggaaggaatatttttattaaccaaataaaatctatttac

SEQ ID NO: 25466 - DNA, 736 bp, Homo sapiens
tggttctcgggggcttaggcacccgggtgctgtatcggcgggtttcttcccatctcctggacatttactttatatgctgcggcggaggtcgtacctccttggcctggaggaacccagtggggactgacgcagctccgggtgagctttggcggctgcgtcgagtgacaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaagttt

SEQ ID NO: 25467 - DNA, 5464 bp, Homo sapiens
ctttcctgttggaattggcgactgctgcggggctgagcgctggtttcacgcgtctcgggagccaggttggtggcgcgatgagttgcagcaaggcctacggggagcggtacgtcgcctccgtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatctggtgttgaagattgcagaattgctttgtaaaaatgatgttactgatggaagagcaaaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtatgtaaacagctttgtacagaaagacaaaaatcttggtgggatgcggtttgtactctgattcacagaaaagcagtacctggaaactcagcaaaattgagacttttagttcagcatgaaataaacactctaagagcccaggaaaaacatggccttcaacctgctctgcttgtacattgggcaaaatgccttcagaaaatgggcagtggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggagatcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaaggaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctataagactgaggacagcgatgacatccattttgaaccagtagttcaaatgcctgaaaaagtagaacttgtaataggagaagaaggtgaaaaagttctgtattcacagggggtaaaactatttagatttgatgctgaggtaaggcagtggaaagaaaggggcttggggaacttaaaaattctcaaaaacgaggtcaatggcaaaccaagaatgctgatgcgaagagaacaagtactaaaagtgtgtgctaatcattggataacgactacaatgaacctgaagcccctgtctggatcagatagagcatggatgtggtcagccagtgatttctctgatggtgatgccaaactagagcggttagcagcaaaatttaaaacaccagagctggctgaagaattcaagcagaaatttgaggaatgccagcagcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactgtgatttaagggaagatgctttggatgatagtgtcagtagtagctcagtacatgcttctccattggcaagtagccctgtgagaaaaaatcttttccattttggtgagtcaacaacaggatctaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaaaaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacacaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcatctttgaaaagtaacaacagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcacttaaacggcctgcttcgggaagcagaggcaaccagtgcagtccttatggagcaaattaagcttctcaaaagtgaaataagaagattggaaaggaatcaagagcaagaggagtctgcagctaacgtggaacacttgaagaacgtcttgctgcagttcattttcttgaagccaggtagtgaaagagagagacttcttcctgttataaatacgatgttgcagctcagccctgaagaaaagggaaaacttgctgcggttgctcaaggtgaggaataaaatgcttcccgttcttctggatgggcatcctatcttcgtagttggtttggacttcgataggttgatggaaggaatatttttattaaccaaataaaatctatttacaaaaa

SEQ ID NO: 25468 - DNA, 7253 bp, Homo sapiens
gtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaaccaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatatttttatggctgc

SEQ ID NO: 25469 - DNA, 2907 bp, Homo sapiens
acacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctga

SEQ ID NO: 25470 - DNA, 541 bp, Homo sapiens
gaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattg

SEQ ID NO: 25471 - DNA, 3304 bp, Homo sapiens
ataaaccccagggctcattcttgagctgctcctgcatagatctcgtcctgttcaacacaccaaagattgacagctgaactgagagaccatcacccacagacacaactggccactgggtggtgcacaagtcagacagaactgaatagtcctgtgaagactctggacactgaactgactttggaaccagactgcagaatggaggggtgggaacttgtggcttgaacctaatcaggtttcattaaggttttctatagataagatcatgtcaagacaccctcagaccacagggcggcgccacgagcccggccgagtgcagctggagcgccgacgtcgccgaggatacacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 25472 - DNA, 7165 bp, Homo sapiens
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttccaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgacggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctatattagaagaaaccacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgtatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatgcttcccgttcttctggatgagcatcctatcttcgtagttggtttggacttcgataggttgatggaaggaatacttctattaaccaaatagaatctgtttacaaaaatggttcgtgtgtgttaccattattcttttgtcaaaaagtgtgtatatatgtttgcatttacatatatttgtacatctgtatgacagatgtattttaaaagtttcaacttgaagtaaaagtacaacagcttgaagtgttgataccaggccacagccctctaactcatgtgatctcccatgcatgctgccagaataaaaccaccaggaatgaattcactccccacttctctggaacctcaggacccgcccatttctcggcagtactgtgaattttgaagttaaactaaattttggtaccataccaactggaatttaggctttaaaaataatgtttcaaggccaggtgtggtgattcatgcctgaaatcccactactttgggaggctgaggctggagaatcgcttgaggctagtgagctgtgattgtaccactgcactccagctcggggaacagagcgagaccttgtctctaaaaataataatagtaataaaaataacgttttatgactatttattgcaaggtcagatttacagattgttataaattgttgagaaatttttgtgattagaatatgaaggaaaaagctttgttggtaaaagtgacatgttaaggggctatgaagtaaatatgctgcagttaattgtgctaagttaaaatacagtttagttatttgctttaaaataaactcttctttttttctttaaagtatactacctcaaaactcattatgttgtcagagccctagagctggctagtgtaacactgactatgagtaggtgggcccaccacttgagttgaggtgatttcatggtgtctttccaggctcttgatagggtgtcactgcatgcaagccatgaatctgttttgagaatcctctccattttcccaaataaaaacctatcccaacagtgactatatcactcagcattggatctaaatataaaagtggtgctttcagtgtttttggcagatagtgttccataacctttccatcagaagggattttagacaccttagaggtccgtgctacatcttcacagttcctccgaataaccttaggtggtagtgttacttgcctttgacacctgtgcatatgttttaatgactagatccaaactgtgttgttcttaaatcaaaaattggataatttttaatatttatgtattaatcacacagtgtgctctctgaagttctcttaagccttcagtttatactcttaattttctttctgagctggggaactgactttgcactttggttacacagaacattggtttccaatttagtttaactgaaatttgctgctgatatgttgagtttgttctttaaaaaatatctcatatatctcgtctttcctccttagaagaacagacctaactagcgaatgtatgaatgaaaatgcatctatttcagagccgacatgaagagtttagtttttttactttataaactgtgaatatgagtatgccagctgcattagatgtaactaatcatatttaaatatatttcactttgactttagaccttttgaagtctgtataaacttgttttgaaatacagtctccacttacgaatgtcataacaaaatacttttttgcatgataaaaaattactttgattacaaaaggcatattctttcatggtttctgcaatgagaggaagtgtaatgattattttaatatttctattaaaactgtatattttta

SEQ ID NO: 25473 - DNA, 2848 bp, Homo sapiens
ctttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcaagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatgttggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagaagcagcacatcgtcattttacaattgagaaacatggagactccaaatggattatttacaggttcacaaaacagctttgtggcactgaaagggcgagagccaagatctcctgatttctgttcctgtgttcatagattctttttccttaataaaagtaaacatatatcaa

SEQ ID NO: 25474 - DNA, 5576 bp, Homo sapiens
acacagtgctgaggcagaacgcaggttcgtcacagtgggcctccgtgggcggcgccgcacgctcgtcacagtgggcctccgccggctacgccgctgcttcagtggcttgcaggcactttcctcttggaagtggcgactgctgcggggctgagcggtgctcgcacgcgtctcgggagccaggttggcggcgcgatgaggcgcagcaaggccgatgtggagcggtacgtcgcctcggtgctgggtctcaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcaaaatactgggtcgaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccactgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaaatagagaattactggaaagttttgatagtgctcttcagtctgcgaaatcttctttgggtggaaatgatgaactgtcagctactttcttagaaatgaaaggacatttctatatgtatgctggttctctgctcttgaagatgggtcagcatggtaataatgttcaatggcgagctctttctgagctggctgcattgtgctatctcatagcatttcaggttccaagaccaaagattaaattaagagaaggtaaagctggacaaaatctgctggaaatgatggcctgtgaccgactgagccaatcagggcacatgttgctaagcttaagtcgtggcaagcaagatttcttaaaagaggttgttgaaacttttgccaacaaaattgggcagtctgcgttatatgatgctctgttttctagtcagtcacctaaggatacatcttttcttggtagcgatgatattggaaaaattgatgtacaagaaccagagcttgaagatttggctagatacgatgttggtgctattcgagcacataatggtagtcttcagcatcttacttggcttggcttacagtggaattcattgcctgctttacctggaatccgaaaatggctaaaacagcttttccatcgtttgccccatgaaacctcaaggcttgaaacaaatgcgcctgaatcaatatgtattttagatcttgaagtatttctccttggagtagtatataccagccacttacaattaaaggagaaatgtaattctcaccatagctcctatcagccgttatgcctgccctttcctgtgtgtaaacagctttgtacagaaagacaaaaatcttggtgggatgcggtttgtactctgattcacagaaaagcagtacctggaaacttggcaaaattgagacttctagttcagcatgaaataaacactctaagagcccaggaaaaacatggccttcaacctgctctgcttgtacattgggcaaaataccttcagaaaacgggcagcggtcttaattctttttatggtcaactagaatacatagggagaagtgttcattattggaagaaagttttgccattgttgaagataataaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcagaaattatctgacaaagaccagggactacctaataaagattatagatgacggtgattcaaatctttcagtggtcaagaaattgcctgtgcccctggagtctgtaaaacagatgcttaattcagtcatgcaggaactcgaagactatagtgaaggaggtcctctctataaaaatggttctttgcgaaatgcagattcagaaataaaacattctacaccgtctcctaccaaatattcactatcaccaagtaaaagttacaagtattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagggaaaagcctcttgaaaatgatactggcttacaggctcaggatattaggggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacgatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaaggcagtggaaagaaaggggcttggggaacttaaaaattctcaaaaacgaggtcaatggcaaactaagaatgctgatgcgaagagaacaagtactaaaagtgtgtgctaatcattggataacgactacaatgaacctgaagcccctctctggatcagatagagcatggatgtggtcagccagtgatttctctgatggtgatgccaaactagagcggttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgtggccggtgcctcagacacaacaataaaacccaatgctgaaaacactgggcccacattagaatgggataactatgacttaagggaagatgctttggatgatagtgtcagtagtagctcagtacatgcttctccattggcaagtagccctgtgagaaaaaatcttttccgctttgatgagtcaacaacaggatctaacttcagttttaaatctgctttgagtctatctaagtctcctgccaagttgaatcagagtgggacttcagttggcactgatgaagaatctgttgttactcaagaagaagagagagatggacagtactttgaacctgttgttcctttacctgatctagttgaagtatccagtggtgaggaaaatgaacaagttgtttttagtcacagggcagaaatctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaatcacaagagagaggacagatgttattcagggtgatgatgtagcagatgcagcttcagaagttgaagtgtctagcacatctgaaacaacaacaaaagcagtggtttctcctccaaagtttgtatttgtttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggcatgctgaatttaccaaagaagaattggttcagaagctccgttccaccacaaaaagtgcagatcacttaaacggcctgcttcgggaaatagaggcaaccaatgcagtccttatggagcaaattaagcttctcaaaagtgaaataagaagattggaaaggaatcaagagcgagagaagtctgcagctaacctggaatacttgaagaacgtcttgctgcagttcattttcttgaagccaggtagtgaaagagagagacttcttcctgttataaatacgatgttgcagctcagccctgaagaaaagggaaaacttgctgcggttgctcaagatgaggaagaaaatccttcccgttcttctggatgagcatcctatcttcgtagttggtttggacttcgataggttgatggaaggaatacttctattaaccaaatagaatctgtttacaaaaa

SEQ ID NO: 25475 - DNA, 2511 bp, Homo sapiens
gcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 25476 - DNA, 2774 bp, Homo sapiens
cgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 25477 - DNA, 2752 bp, Homo sapiens
ccccgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 25478 - DNA, 1242 bp, Homo sapiens
actttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggagcaggggagagaagacagaagaggttggagaggtcagggaggtgccagatcatggaggccctcgtgtgctgccacgagttgattctaagagtagcgtggagccattggaggggcctaactggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgag

SEQ ID NO: 25479 - DNA, 1653 bp, Homo sapiens
cactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggagacaccagcgggggctgccgctgcagggtaaatgggattccttgccacccaagctgtcagaactgccactgagctaaagatggtggggccacatgctgacccagccccacatc

SEQ ID NO: 25480 - DNA, 593 bp, Homo sapiens
gccggaggaggtgagggatgagattctgcaagtggagcccgcaggatctgctgatcgatgggacgaggaacgggagaaaaattaaagcggcgcatgaggcagacgaatgcaaacttcaccaatagctcaacgaaaagacagacggtgaccgctgagaggcagcgtcggatctgggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatg

SEQ ID NO: 25481 - DNA, 765 bp, Homo sapiens
aggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggagcaggggagagaagacagaagaggttggagaggtcagggaggtgccagatcatggaggccctcgtgtgctgccacgagttgattctaagagtagcgtggagccattggaggggcctaactggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgagg

SEQ ID NO: 25482 - DNA, 2613 bp, Homo sapiens
cgcctgcggcccagctccttcccgcggctctgcgatgcggcccgcagggtgacccgggcgggagtccggggacccgcgatcagccccggaggacggggtggggtcgccccaaacaggagcgccgggaccgctgggaccccgcactcggcgtccgccgccgccgggtagccgggcagtggaggtcccggatgaggcgacaatttttccggccccccctcccagtcccgccccacttccggggccgccactttcactttctcttccgccgaagccgctccccttgcgaagaactggggcctcccgggaggagagagggctttgccttgaaacccgggacgccaggggcgctcccgcaagtgggggtcctccgggacttggaacgccccggctgggtggtgtccgggcgtcctttccccgcttcttcccacctcggctggtcccgtttcctcctgcgcccagtgcggacctgtctcggcgcccgctgccctctcaccgccccacgcaggatcccggcctggtcaccgggcagtgtgatgcttcccgactgccgcggggacagcgaggcacacacagggcttgggccgcgccggaggccacacggcctggctgagttgctcctggtctcccgcctctcccaggcgacccggaggtagcatttcccaggaggcacggtcccccccagggggatgggcacagccacgccagatggacgagaagaccaagaaagcagaggaaatggccctgagcctcacccgagcagtggcgggcggggatgaacaggtggcaatgaagtgtgccatctggctggcagagcaacgggtgcccctgagtgtgcaactgaagcctgaggtctccccaacgcaggacatcaggctgtgggtgagcgtggaggatgctcagatgcacaccgtcaccatctggctcacagtgcgccctgatatgacagtggcgtctctcaaggacatggtttttctggactatggcttcccaccagtcttgcagcagtgggtgattgggcagcggctggcacgagaccaggagaccctgcactcccatggggtgcggcagaatggggacagtgcctacctctatctgctgtcagcccgcaacacctccctcaaccctcaggagctgcagcgggagcggcagctgcggatgctggaagatctgggcttcaaggacctcacgctgcagccgcggggccctctggagccaggccccccaaagcccggggtcccccaggaacccggacgggggcagccagatgcagtgcctgagcccccaccggtgggctggcagtgccccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcagggagtgcctgcagggcaccatccgcaacagccaggaggcggaggtctcctgccccttcattgacaacacctactcgtgctcgggcaagctgctggagagggagatcaaggcgctcctgacccctgaggattaccagcgatttctagacctgggcatctccattgctgaaaaccgcagtgccttcagctaccattgcaagaccccagattgcaagggatggtgcttctttgaggatgatgtcaatgagttcacctgccctgtgtgtttccacgtcaactgcctgctctgcaaggccatccatgagcagatgaactgcaaggagtatcaggaggacctggccctgcgggctcagaacgatgtggctgcccggcagacgacagagatgctgaaggtgatgctgcagcagggcgaggccatgcgctgcccccagtgccagatcgtggtacagaagaaggacggctgcgactggatccgctgcaccgtctgccacaccgagatctgctgggtcaccaagggcccacgctggggccctgggggcccaggagacaccagcgggggctgccgctgcagggtaaatgggattccttgccacccaagctgtcagaactgccactgagctaaagatggtggggccacatgctgacccagccccacatccacattctgttagaatgtagctcagggagcttcgtggacggccttgcttgctgtagcgttgtaggggccctgcctgcactgcggttgtccacggtcacatctgccccagtgcctttgtccttcccttggggcttgccggccagacttctctcccctgcggctcccacctctgcctgaccccagccttaaacatagcccctggccagaggccttgctgggtggagcctctgtgtgactccatactcctcccaccacaacactcatctgtcaaacaccaagcactctcagcctccccgccttcagctgtcagctttctggggctaacttctctgcctttgtggttggaggcctgaggcctcttggaactcttgctaacctgttcagagccaggaaggagactgcacagttttgaaagcacagcccgtcaggtccggctctgcgtctccctctctgcagcctgtgtaagctattataattaaaatggttttccgggaa

SEQ ID NO: 25483 - DNA, 5618 bp, Homo sapiens
ggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagg

SEQ ID NO: 25484 - DNA, 8079 bp, Homo sapiens
cccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagctgttggtttttattatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattaccaaaaaaaaaaaaaaaaaaaaagccaaagccattaacgtgcactacccagatcaacttggagccaaaaggggtttacttctgaatggctgtccgtatgtgtccacataggatttagttggtttgtggcctcctttatagaaatgtgttgtctttccctagctgtctctgctgtctgtcttcctgcatatcccccttcattttaaaatcatgaatcagttgtaagtggtaaatggtagtagttcatctttcccatcaacatgattgtctctttattttaggaataatagcatttcaaaaattcctgtggtaaagaaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgccaaatagtaagtttcaacaaaatatctttatagtgaaagattttgagaattagtaaatccagtacatgattccataaaagcttattaaagttaataattctaatttactccaaatgattactttcaatatgatctttggggagaaaaagcctttagtgaattttcttgagggtgataaatcacatcattgcgatctatatcacctccttgagaatctctcccaggctgaaaatgtgatggtaatcatgggtgtttttaagaacaaatctaatttttatcaagtgttctttcctctacaaaaaaggaaggaggagaaaaagcttccttaaaactgattattttgattcaattttaagtttctaaaaaaggtgatattaaagtatatgtattccttcagcattaccttaaaggctagaaaaacgggataaatcttcagaaaagtgtcaaaagtgtcacagtacatgttcaaatttaaacttgaatcctggttcatctttgacttttgttgtgcatttttaatgcttctttatttttgatacacagaatgcagttgaacttgatcttttaaaattgagacatgtaagctaatcagcaaaagacagaaacaaaactgcacatctgtaataatcagatagcaattctactgcacaattcattgattgtaaggtatcctgtaacaagcaatgtttgtctcctattttttgatacctcttaaacttatgtcttttagaaagacagtgcctctgtatgctttttgtatttttactgagtgtaaatatttgttatatttttggttaagagaatgtaaaaataccatttattattatcatatctactaatacattggtggaatcaataaagaatctacatt

SEQ ID NO: 25485 - DNA, 4733 bp, Homo sapiens
cccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagcaaaagggtttaaaaatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattggtaagaaacaaacaagttatttc

SEQ ID NO: 25486 - DNA, 5727 bp, Homo sapiens
gtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggaagaagaggtggcggagtctggggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcc

SEQ ID NO: 25487 - DNA, 8357 bp, Homo sapiens
cccgcgcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaaggttacacacttattccatcagctaaatctgacaacttgtctgactccagccatagtgagatttcttcacggtccagcatcgtgagcaattgttctgttgactccatgtctgcagctctacaggatgaacggtgttcctctcaggccctggcagtccctgaatccactggggcattggaaaagacagagcacgcttcagggataggagatcatagtcaacatggccctgggtggacactcttgaagccatctctaatcaagtgtttagctgtctcatcgtctgtgagcaatgaagagatttctcaagagcatatcattatagaagcagctgacagtggtcgtggaagttggacttcgtgttcaagcagctcccatgacaacttccaaagccttccaaacccaaaaagctgggattttttgaactcttacagacatacccatttggatgaccccattgctgaagttgaacccactgactctgagccctattcctgttctaaaagctgctctagaacttgtgggcagtgtaaaggaagcctagagagaaagagttggacctcctccagttctctgtctgacacgtatgaaccaaactatgggacagttaaacagagagtattggagagcaccccagctgagtcatctgaaggcttggaccccaaggatgccactgacccagtttataaaactgtcacttcaagtacagaaaagggcttgattgtgtactgtgtcacctcacccaagaaggacgataggtatagggagccacctcccactcctccaggatatttggggatttctttagcggacctaaaggaaggaccccacacacacctaaaacctccagattatagtgtggcagtgcagaggtcaaagatgatgcataacagcctctctagactgccaccagcttctctcagtagcaacctcgtggcctgtgttccatcgaagattgtaactcagcctcagaggcataatttgcagccattccatcctaaactaggagatgtgactgatgcagatagcgaagcagatgaaaatgaacaagtttcagcagtctagcctttggatgacctatttgaaaaccactgaaagtcgtggaggaatgggcaagaaccacctcatgattctgcaggccattgctaacgaacagctcattgctacaaccagtccagaggttttattccctctactccgagcaatgaaatagacctgagttatgcttcctttcatttaatttctgcagataaatagtttcctgagcaatggatgctatgcctggataccagtctccactttgcacgccggaactgccttgggaccacagttacagaaaaaatgtaaactcagagtgatccttgtgtatattgctatagatttttctttaacaagctattttaaagataatggcattattatttccaagccatagcttgggctgaaggacaaattgaaattgtctgccaataccaaggatattcttgtatatttgaaaaataacttattatttgaattgttgtggttttgtttgtatttgagagctcttgttagctgatattcatgtttgaggtcataaaattgtctctggtctgaccaaacagaagtcatctttacagaggtgatatgcttgatctacacagagatgtgacttgatctgtagcaccaatgcaatgtaggtctcagtttgagagaaataggaagccctttgcagttgaggtgttaggaacctgctggtcatggtgtggaaggccaaatgaagctgccacagggtttcttgtcagtcctttgggaaatgggagggagtagtttggggaggagggtgggaaccctaatttccacagaatgaaattttgatgttaaatgacatgtatacaaattcttccttaagtgaaagttatgctgcatcgaattgtaactgaaagtatagatccaacaaatagagactgggttctagagagttctggtctatagaaacccaaaactaaaatctctcataactcaagtatggaatactttttttaaagaaattcttatcatgggtgttgtaataatgaagacgaatttgactttatgcagtgttctgcagcatgcctcccccacatctcatagcaccaggttgtgtctgacctgacataccctgcagctctcagctggctgcagtaacattttgtgggagaaagaggagctggagttacagaaatgattgtctcttggttctcagtttttagcccttgagaggacatacttttccagcctcatgggtatggcactcttaattaaaatttcagtgactgtttactggatgaggcagatttttcacatttttgcaaattaaatatattttatatatattaagtttaattttttcagtttttttaatgtaaaagcaagtgaaattttaataaacttctgtaattaccaaaaaaaaaaaaaaaaaaaaagccaaagccattaacgtgcactacccagatcaacttggagccaaaaggggtttacttctgaatggctgtccgtatgtgtccacataggatttagttggtttgtggcctcctttatagaaatgtgttgtctttccctagctgtctctgctgtctgtcttcctgcatatcccccttcattttaaaatcatgaatcagttgtaagtggtaaatggtagtagttcatctttcccatcaacatgattgtctctttattttaggaataatagcatttcaaaaattcctgtggtaaagaaacattaatctgaaacttaagccttagaaattaatcgcaggtatgatagaatgaggcttggtggttccatagctttcttggtcctttgaaatgggaaataacctgaaccaaaaatcctagtttgaaagttacacttcagtgatttggcctataaacagtggtcctatgattatacattttttccttcactgatttgcataattttgttttcatggccacagcaaaacaatgtgaaatatatttttgctatacccactttttttatcaaattcagatgtctactctcaccattttatattcatttccccagaaaaatgtgctgttttcataatgtctttatttagcaggtctttcaaaccaaatggaagccttacctgtctttgtccttaatagtgtaaatatcttgcacagagtgttgaggcctatggttttggacttgcaccttacagctgcctttgttttatctatctagctttaactgtgagtgttcagatcagctgatcacattgatcaggagccaaagccaaatgctttgtagtttgttatgtatgtatcccttaaaaaatcatgaggttttgatttttatattttaactaagggtacattcctgccttctcttagtttgtcatatgactagaacaagagaagtcttaagctgcatttactccaattccagatctccatttgtttttgttttataaatttataatcttaatgaagagactagtgccctctcttcctgccacaactctcaatctgccaagactgttgaagcagttaacgctcagtgcaaacttttgccaaatagtaagtttcaacaaaatatctttatagtgaaagattttgagaattagtaaatccagtacatgattccataaaagcttattaaagttaataattctaatttactccaaatgattactttcaatatgatctttggggagaaaaagcctttagtgaattttcttgagggtgataaatcacatcattgcgatctatatcacctccttgagaatctctcccaggctgaaaatgtgatggtaatcatgggtgtttttaagaacaaatctaatttttatcaagtgttctttcctctacaaaaaaggaaggaggagaaaaagcttccttaaaactgattattttgattcaattttaagtttctaaaaaaggtgatattaaagtatatgtattccttcagcattaccttaaaggctagaaaaacgggataaatcttcagaaaagtgtcaaaagtgtcacagtacatgttcaaatttaaacttgaatcctggttcatctttgacttttgttgtgcatttttaatgcttctttatttttgatacacagaatgcagttgaacttgatcttttaaaattgagacatgtaagctaatcagcaaaagacagaaacaaaactgcacatctgtaataatcagatagcaattctactgcacaattcattgattgtaaggtatcctgtaacaagcaatgtttgtctcctattttttgatacctcttaaacttatgtcttttagaaagacagtgcctctgtatgctttttgtatttttactgagtgtaaatatttgttatatttttggttaagagaatgtaaaaataccatttattattatcatatctactaatacattggtggaatcaataaagaatctacattaa

SEQ ID NO: 25488 - DNA, 4103 bp, Homo sapiens
agtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgatgtgaatttagtgctcttgaaaagggctggactggcagccctgcagcctcttcccgtatacccacagcacagatgcaccacagatacaagtttacctcagaaagttttaggaacaactgaagaaataagtggtaagaagcatacagaagacactatttctgtggcgtcatctttacattctagtcctcctgcatctcctcaaggctcccctcacaaagttggcagtatcatatctgatcacagcagcaagatcagtggccagagctgccccggaataggtggggcttacttgcaaaagaaaatccttcag

SEQ ID NO: 25489 - DNA, 4176 bp, Homo sapiens
atgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtattacttaaaaaataacatggaaacagaaaccttatgttcagatgaagatgctcaagaactagttaaggaaagccagctatccatgctgcagctcagtaccattgaggtggccacccagctgtcaatgagggactttgatttgtttcgtaatattgaaccgactgagtacatcgatgacctttttaagttaaattccaaaacaggaaatactcatttgaagaggtttgaggacattgtaaaccaagagacattctgggttgcctcagaaattttaactgaagcaaatcagctcaaacgaatgaagattattaagcattttattaaaattgcacttcattgtcgagaatgtaagaacttcaattccatgtttgcaataataagtggcttgaacctggcatctgtagcaagactcagaggaacttgggaaaagttaccaagcaaatacgagaaacatcttcaagatctacaagacatttttgatccatctagaaacatggcaaagtatagaaatattcttagtagtcaaagtatgcagcctccaattattccactcttccctgttgtcaagaaagatatgacatttctacatgaaggaaatgactccaaagtagatggtttagtaaactttgagaagttaagaatgatttccaaggaaatccgccaagttgttcgaatgacttctgctaacatggacccagctatgatgtttcgacagaggtcactgagtcaaggaagcacaaattcaaacatgctggatgttcagggaggtgctcacaaaaaaagggcacgccgcagctctctgcttaatgccaagaagctatatgaggatgcccaaatggcaaggaaggtgaagcagtatctttccagtctcgatgtagagacagatgaggagaagttccagatgatgtcattacagtgggagcctgcatatggtaccttgaccaagaatttaagtgagaaaagatcagccaaatcatctgaaatgtctccagtgcctatgaggtcagctggccaaacaactaaagcccacttgcatcaaccccacagagtaagccaggtgcttcaggtgccagctgttaatttgcaccccatcaggaagaagggacaaacaaaagaccctgcactgaatacaagtttacctcagaaagttttaggaacaactgaagaaataagtggtaagaagcatacagaagacactatttctgtggcgtcatctttacattctagtcctcctgcatctcctcaaggctcccctcacaaagttggcagtatcatatctgatcacagcagcaagatcagtggccagagctgccccggaataggtggggcttacttgcaaaagaaaatccttcagattaccaggagcacagccaaaagaacagacagtactgagaaggccactgaggagaatagagacaggacaagttgtgagaacacaaccagaaaaagaatgacatccccgtttagaagacttagggaaagaatgctttcaagggagagactagtcaacagccaaaaagaggacacagatcacaatcaagctacagaaagctgtgagaaagtgaaggatgttggaagcaacatcaaagatgagaaagggagtgccatcttcaattcaaatagccaaggcaacagtaacactttaaactgcttctatacgcgattcaagtctaaaaggaggaagacactctga

SEQ ID NO: 25490 - DNA, 3107 bp, Homo sapiens
gcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcagggaacatcagcttagattaatgtctgcaagagcacgctatgagagatacagtggcaatcaggttctcttttgttcagaaacgattgccagatgttggtatatcctactttctggatctgtgcttgtgaaaggctccatggtcttgcctccttgcagttttggtaagcagtttggaggaaaaagaggatgtgattgtcttgtattagagccttcagaaatgattgtggtagagaatgccaaagataatgaagatagtattctacaaagagaaattcctgccagacaatcccgaagaagatttcggaaaattaactataaaggagagcgccaaaccattactgatgatgtggaggttaacagctatctttctcttccagctgatcttaccaagatgcatctcacagaaaaccctcatccacaggtgactcatgtgtcttctagtcagtctggttgtagcattgccagtgactctggaagcagcagtttatctgatatctatcaggctacggagagtgaggtaggagatgtagatttgacacgtcttccagaaggacctgttgattctgaggatgacgaagaggaagatgaagagattgatcgaacagatccattgcaggggcgagatcttgttcgagaatgtcttgaaaaagaacctgcagacaaaactgatgatgacattgaacaattgctggagtttatgcaccagctccctgcatttgcaaacatgaccatgtctgtaaggagagaactctgctcagtgatgatttttgaagtggtagagcaggctggagctattattcttgaagatgggcaagagcttgactcatggtatgttattttaaacggcactgtggaaatcagtcatccagatggaaaagttgaaaatttgtttatgggaaatagttttggaattactcccactctggataagcagtacatgcatggaattgtcaggactaaagtagatgattgtcagtttgtctgcatagcccagcaagattattggagaattttaaaccatgtggaaaaaaatacccataaagttgaggaagagggagaaattgttatggtacatgagcatcgggaactagaccggagtggaaccaggaaaggacacattgtgatcaaggcaacacctgagcgtctcataatgcatttaatagaagaacattccatcgtggatccaacttatatagaagattttctattaacttacaggacatttcttgaaagtcctttggatgttgggatcaaactattggaatggtttaagatcgacagcttaagagataaggtgacacggattgtattattatgggtaaataatcattttaatgattttgaaggtgaccctgctatgactcgatttctagaggaatttgaaaaaaatctggaagatacaaagatgaatggtcatctccggttattgaatattgcctgtgctgcaaaggctaagtggagacaggttgtgctgcaaaaggcttcccgcgagtcccctctacaattcagccttaatggagggagtgagaagggatttggtatttttgttgaaggagtagaacctggtagcaaagctgctgattcaggactgaaacgtggtgatcagattatggaagtaaatggacaaaactttgagaatattacatttatgaaagccgttgaaattttgaggaataatactcatcttgcacttactgtgaagaccaacatttttgtgttcaaagagttactttttaggactgaacaagagaaatctggtgttcctcatattcccaaaattgctgaaaaaaaaagtaatcgccattctatccagcatgtgccaggagatattgaacagacatcacaggagaaaggaagtaagaaagttaaagcaaatactgtttcaggtggaagaaacaaaatcaggaagattttggataaaacacgatttagtatcttgcctccaaagctatttagtgatggaggcctaagccaatcacaagatgacagcattgtgggaacaaggcactgtaggcatagtctggctataatgcccatccctggaacactctcatccagcagccctgatctcctgcagcctaccaccagtatgttggatttttccaatccttcagatatccctgatcaagttataagagttttcaaagtggatcagcaaagttgctacattatcatcagtaaagacaccacagctaaagaagtagtttttcatgctgttcatgaatttggtttgaccggtgcatccgacacatattctctctgtgaagtttctgttactcctgagggtgtcataaaacagagaagacttccagatcagttctccaaattagctgatagaattcaactcaatggaaggtgaataagcttattagtggatgtgcttatttgtagatgtgcttttgaagatttcctgttaaaacagctattgtaagtagaaacattatcatgttttagtgctcctaaattcactccagaagacgcttgataaaatatcttgtcactcctgctaaaataaactcttagaaccactgatataatctagttcctgtttttttatagaggaagctgaatgatacaaatcttcatatatatctgaatgactgtatctactaatttataaatttgtttttaatatggccagtatgtactttggcaaaagaagccatggttttcacagttctttttctaagtagttttcctttaatgaatatgcaggaaaattttaaaaattttaaaatgtgttctgaaaattatttaataaactagattatttctgtagta

SEQ ID NO: 25491 - DNA, 1686 bp, Homo sapiens
ctccccggcggccgccccccgcgggtccctccctggctgcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctga

SEQ ID NO: 25492 - DNA, 2092 bp, Homo sapiens
cacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccg

SEQ ID NO: 25493 - DNA, 2085 bp, Homo sapiens
agcaccagctgctcctccccggcggccgccccccgcgggtccctccctggctgcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtaga

SEQ ID NO: 25494 - DNA, 1942 bp, Homo sapiens
cacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccg

SEQ ID NO: 25495 - DNA, 3681 bp, Homo sapiens
gggtccctccctggctgcgggagagacggaggtagagggaggacacagagccgcgccgcccgcaccacagaccttcgcctcgccccgccggttcctcaccctcggggagcaacatggataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaacttctggtttctcctttttcctttttagactattgaaactgccacaaacttggcaagactttctgaggtttctgattccatatttaattgactattatcaatagcctgatattgaaaaacatttgtagttttcagtgtgaaactaaggggttgaagaatcactattacaatccctattacagagcatttcgggttttgcttgtattttagattctgatacatacgctgtttcactcaggaactacttctaccagttaatcagcattatccagcacttgtctttaaaattcatttggcgcttgtttgttttcaactgaggaaattgagtatagttcattgaagaatggaatttttttttttttttttttttttgctgtttttcatcattcagctagaaagtgagaagttttatcttccatagtccttttaaatcttatgttagaactagcaggacgtaggtggaaagatgaagaaataagcttgtctagactaaagaaaggaaagcaggttataaaagccatagtagccagtccagttcattctgcagatggccccataccaatcgctgttagagtttgccacctccactttcccactgagaactgcagcaattttaaaggatatgagaaagccaagactcaagagatgagaagacccccttggcgaaatatagtgtactcttcactgccactgccaccaccaaatgggtttttagagctttgaaacacaatctttgtaaattaatcaaaacctccctgtgacccacctgccttctccccatacccaaatttgaccactactggcctaaaaggcaagatgggcttcgatatagaaggactgcaagacagtagaaagggctgccacggaggtgacagtagctccttcctctccaacatgtgatgctacacatctctgtggataatctaagttggacttttgactctaaaacagctataatccaagaaagttaaattctaatggaggtaaagaatcttgactgattgttccctttgatgtccaaataagggaactattgtgagtacgtatgctacacttactataagaatgatactgtttgttgtctttctcctgggctggatagtggactatattttattacaggctttgaaagacatctgtaatgttgcatatctgttcatattaataacttaataaatagtatatgaagctataa

SEQ ID NO: 25496 - DNA, 2470 bp, Homo sapiens
gcgggagagacggaggtagagggaggacacagagccgcgccgcccgcaccacagaccttcgcctcgccccgccggttcctcaccctcggggagcaacatggcagataatctcagtgataccttgaagaagctgaagataacagctgttgacaagactgaggatagtttagaaggatgcttggattgtctgcttcaagccctggctcaaaataatacggaaacaagtgaaaaaatccaagcaagtggaatacttcagctgtttgcaagtctgttgactccacagtcttcctgcaaagccaaagtagctaacatcatagcagaagtagccaaaaatgagtttatgcgaattccatgtgtggatgctggattgatttcaccactggtgcagctgctaaatagcaaagaccaggaagtgctgcttcaaacgggcagggctctaggaaacatatgttacgatagccatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatgattcgcttcaagctcagcttatcaatatgggtgttattcctaccttagtgaaattactgggcatccactgccaaaatgcagctcttacagaaatgtgtcttgttgcatttggtaatttagcagaacttgagtcaagtaaagaacagtttgccagtacaaacattgctgaagagctagtaaaactcttcaagaaacaaatagaacatgataagagagaaatgatttttgaagttcttgctccattggcagaaaatgatgctattaaactacagctggttgaagcaggcctagtagagtgtctactagagattgttcagcaaaaagtggatagtgacaaagaagatgatattactgagctcaaaactggttcagatctcatggttttattacttcttggagatgaatccatgcagaagttatttgaaggaggaaaaggtagtgtatttcaaagggtactctcttggatcccatcaaataaccaccagctacagcttgctggagcattggcaattgcaaattttgccagaaatgatgcaaattgtattcatatggtagacaatgggattgtagaaaaacttatggatttactggacagacatgtagaagatggaaatgtaacagtacagcatgcagcactaagtgccctcagaaacctggccattccagttataaataaagcaaagatgttatcagctggggtcacagaggcagttttgaaatttcttaaatctgaaatgcctcctgttcagttcaaacttctgggaacattaagaatgttaatagatgcacaagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagatgtaattaaaaccattgtgcagagtggtggcatcaagcatctagttaccatggcaactagtgaacatgtaataatgcagaatgaagctcttgttgctttggcattaatagcagctttagaattgggcactgctgagaaagatctagaaagtgctaaacttgtacagattttacatagactgctagcagatgagagaagtgctcctgaaatcaaatataattccatggtcctgatatgtgctcttatgggatctgaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaa

SEQ ID NO: 25497 - DNA, 2129 bp, Homo sapiens
acccgcgcgccccgcccgcgggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataattacttgccacttgaatgtgttttgtgtaatgttttaacagtgctagtaaataaatacgggtttaccctg

SEQ ID NO: 25498 - DNA, 714 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatata

SEQ ID NO: 25499 - DNA, 1017 bp, Homo sapiens
aggcgtgtaaaccagccggagcggcgcggcagcggcaggaccgccgtggcgcctagagtagcgacccggggggagcgcggggcgacgctggctgcagggacccggtgacagcgtgagaggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtatgttcacttatctttcctctaacttttaatcactcaaccttattaagggcactctgtcatgaaagcaagtatagacttctttttgttggttctgaaaaataaatggtttatttttataagatatccatgagttagtatgctatcttattaattatttacttatcatcatgagtaaagtatttcacataagtattctttttttgagatggagtttcactctgtcacccaggctggagtgcagtggcgcaatatcagctccctgcaacctccgcctcccaggttcaagcaatgcttctgcctcagcctcccgagtagctgggattacaggcacgtgccaccacgcccggctagtttttttgtatttttagtagagatggtgtttcaccattgttggccaggatggtctcaatctcttgacctcgtgatctgcccacctcggcctcccaaagtgctgagattacaggcgtgagccaccactcccagccaaccccgt

SEQ ID NO: 25500 - DNA, 2049 bp, Homo sapiens
gggcggaagctggagcgaggctgaacgcctgacgtcaaggcgacatcgccaaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttgcattataa

SEQ ID NO: 25501 - DNA, 468 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagagcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacga

SEQ ID NO: 25502 - DNA, 1466 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgc

SEQ ID NO: 25503 - DNA, 530 bp, Homo sapiens
aggcgtgtaaaccagccggagcggcgcggcagcggcaggaccgccgtggcgcctagagtagcgacccggggggagcgcggggcgacgctggctgcagggacccggtgacagcgtgagaggttcgcagagttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaa

SEQ ID NO: 25504 - DNA, 1942 bp, Homo sapiens
accagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagattaaagacgttgcctttaatatctgttgggaaggaaatgtccagacttttcaaatctcttattatatgtttcctttttttgtttacatagggaacaatgtttatagtcgtgtgtacagtgggggtctacaacaagaagtgtatattttcaaacaattttttaatgatttaacaatttttgtaaatcattttcaggcttctgcagctgtagattctcactgtgaatcccttgcttgctcatgcataagtgtatttgcaataccaaatatacaggtttagtatttttgcctgttagtgattgtttcacatgtgtaacgttttggttgagatgttaaatggtggacgagtactgtggatgtgaatgtgggaagtaattttaatcatatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgc

SEQ ID NO: 25505 - DNA, 312 bp, Homo sapiens
aaaccagccggagcggcgcggcagcggcaggaccgccgtggcgcctagagtagcgacccggggggagcgcggggcgacgctggctgcagggacccggtgacagcgtgagagaattctttttttttttttcctttaataaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcaca

SEQ ID NO: 25506 - DNA, 561 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagagaccagacacggtggctcacgtctgtaatcccagcactttgggaggccaaggcaggcagagcactttgggaggccagggcgggcggatcacttgaggccagaagttcgagaccagtctggccaacatggtgaaaccccatctttactaaaaatatgaaaattagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctca

SEQ ID NO: 25507 - DNA, 606 bp, Homo sapiens
aggcgtgtaaaccagccggagcggcgcggcagcggcaggaccgccgtggcgcctagagtagcgacccggggggagcgcggggcgacgctggctgcagggacccggtgacagcgtgagaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagt

SEQ ID NO: 25508 - DNA, 1072 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatc

SEQ ID NO: 25509 - DNA, 591 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagaggttcgcagaggtctcacttgtcacccaggctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttc

SEQ ID NO: 25510 - DNA, 550 bp, Homo sapiens
agccggagcggcgcggcagcggcaggaccgccgtggcgcctagagtagcgacccggggggagcgcggggcgacgctggctgcagggacccggtgacagcgtgagaggttcgcagagagctctcaacttaatcatccttcagcaaaaaagaattaagactagccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttg

SEQ ID NO: 25511 - DNA, 977 bp, Homo sapiens
gtgtaaaccagccggagcggcgcggcagcggcaggaccgccgtggcgcctagagtagcgacccggggggagcgcggggcgacgctggctgcagggacccggtgacagcgtgagaggttcgcagagtactaggttttgacaagcttgcatcatgcgtgagtataagctagtcgttcttggctcaggaggcgttggaaagtctgctttggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaag

SEQ ID NO: 25512 - DNA, 1264 bp, Homo sapiens
aggcgtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaaggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaatttttaaaaaacctgtggagacggtgatcttgtctttaaaacatgatagtcctttcagtataatgtcttagatt

SEQ ID NO: 25513 - DNA, 571 bp, Homo sapiens
gtgtaaaccagccggagcggcgcggcagcggcaggaccgccgtggcgcctagagtagcgacccggggggagcgcggggcgacgctggctgcagggacccggtgacagcgtgagaggttcgcagagtgagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaac

SEQ ID NO: 25514 - DNA, 561 bp, Homo sapiens
aaacctcgcccagattcaggcgtgtaaaccagccggagcggcgcggcagcggcaggaccgccgtggcgcctagagtagcgacccggggggagcgcggggcgacgctggctgcagggacccggtgacagcgtgagagacagggtctcacttgtcacccaggctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgattta

SEQ ID NO: 25515 - DNA, 480 bp, Homo sapiens
agccggagcggcgcggcagcggcaggaccgccgtggcgcctagagtagcgacccggggggagcgcggggcgacgctggctgcagggacccggtgacagcgtgagaggttcgcagaccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagaatgtaggagccttttattctcatgtaatgcccccaccctggaatccttgaagaccttctgtctattgttcatatactgaaattttataatgataagccttggtactaggttttgacaagcttgcatcatgcgtgagtataagctagtcgttcttggctca

SEQ ID NO: 25516 - DNA, 633 bp, Homo sapiens
agattcaggcgtgtaaaccagccggagcggcgcggcagcggcaggaccgccgtggcgcctagagtagcgacccggggggagcgcggggcgacgctggctgcagggacccgccaggcatggtggtgtgttcctgtagtcccagctactcgggaggctgagcaggagaatcgctggaacctggcaggcagaacttgcagtgagctgagatcgtgccactgcactccagcctaggcgacagagtgagactccgtctcaaacaacaacaacaacaaaagctcctcgatggaaccatttgatagtgacaaggattgaagtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaa

SEQ ID NO: 25517 - DNA, 1060 bp, Homo sapiens
gtgtaaaccagccggagcggcgcggcagcggcaggaccgccgtggcgcctagagtagcgacccggggggagcgcggggcgacgctggctgcagggacccggtgacagcgtgagaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtac

SEQ ID NO: 25518 - DNA, 874 bp, Homo sapiens
agattcaggcgtgtaaaccagccggagcggcgcggcagcggcaggaccgccgtggcgcctagagtagcgacccggggggagcgcggggcgacgctggctgcagggacccggtgacagcgtgagaggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtttgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcacc

SEQ ID NO: 25519 - DNA, 640 bp, Homo sapiens
tcgcccagattcaggcgtgtaaaccagccggagcggcgcggcagcggcaggaccgccgtggcgcctagagtagcgacccggggggagcgcggggcgacgctggctgcagggacccggtgacagcgtgagagggtctcacttgtcacccaggctggagtgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcacagcacagtccacatttaacgatttacaagacctgagagaacagattcttcgagttaaagacactgatgatgttccaatgattcttgttggtaataagtgtgacttggaagatg

SEQ ID NO: 25520 - DNA, 545 bp, Homo sapiens
aggaccgccgtggcgcctagagtagcgacccggggggagcgcggggcgacgctggctgcagggacccggtgacagcgtgagaggttcgcagaccaggcatggtggtgtgttcctgtagtcccagctactcgggaggctgagcaggagaatcgctggaacctggcaggcagaactttgcagtggcacaaacatgggtcactgcagcctcgactcctgggctcgagtgatgctcccacctcagcctctcaagtagctgggactacaggtactaggttttgacaagcttgcatcatgcgtgagtataagctagtcgttcttggctcaggaggcgttggaaagtctgctttgactgtacaatttgttcaaggaatttttgtagaaaaatacgatcctacgatagaagattcttatagaaagcaagttgaagtagatgcacaacagtgtatgcttgaaatcttggatactgcaggaacggagcaatttacagcaatgagggatttatacatgaaaaatggacaaggatttgcattagtttattccatcac

SEQ ID NO: 25521 - DNA, 4349 bp, Homo sapiens
tcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccaatgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtctttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaa

SEQ ID NO: 25522 - DNA, 1951 bp, Homo sapiens
ccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagggatgaactttttgggattctccaaatactccatcagtgtatcctgtcttcaggtgatgcttttgttcttactggcgtctgttgttcctggaggcagaatggcaagccaccatattcacaaaaggaagataaggaagtacaaactggatacatgaatgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctca

SEQ ID NO: 25523 - DNA, 1908 bp, Homo sapiens
ggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagctcttcaacctgtagctccctgagcaggctgttctggtctcaacttgagcacataaactgggatggagccacagccaagaactttattaatttaagggagttcttctcttttctgctccctgcattgagaaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctca

SEQ ID NO: 25524 - DNA, 10844 bp, Homo sapiens
ttttttttttttttttggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 25525 - DNA, 1701 bp, Homo sapiens
tctcggcgggcgggcagctgcggcagctgctgctgtggctcgggcggcggcggcgcggcggcggcagagggggctccggggtcggaccatccgctctccctgcgctctccgcaccgcggcttaaatgatgtattttgtgatcgcagcgatgaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataa

SEQ ID NO: 25526 - DNA, 2180 bp, Homo sapiens
gccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttaca

SEQ ID NO: 25527 - DNA, 3050 bp, Homo sapiens
agaagcactgggggagagagctaggtgcagagcttcaggctgaggcgctgctgagagggcctcgccccgcctctgccgccagctgcaccccactcctggaccaccccctgctgagaaggacagggagccaaggccggcagagccaaggctcagtcatgagaacacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgagggattaacagcaatgatgggcagtcgtggagttgggggggttgggggtgggattgtgtcctctaaggggacgggttcatctgagtaaacataaaccccaacttgtgccattctttataaaatgattttaaaggcaa

SEQ ID NO: 25528 - DNA, 2326 bp, Homo sapiens
acagagacagcaccgagcctcacgggagaatgtggggcactgggccatcagcagggaaggacagaatgtcaggccgtccttggccccacccatggtccaagtcaggaaccccctcagagcaggatcgcagggccacaggcttggtcagctgtgagcatggaggaggaaagtttgagggccagagccaccaagctccagggccacctggtggaggaagaactggctgcctggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacct

SEQ ID NO: 25529 - DNA, 4505 bp, Homo sapiens
ctttcagtggtgttgttgaaagggcttggcagctcccaaatgtttgcagtgtccttagtcctatgagggctgccttcttcttcttcttcttctttttttttttttttttttgctagcttttagctagtatctggaaacatctactggacatgttggactcattttctcaagaatccactttacccttcagggaagccaggaaaagaacaagcttccaaccggtacaagtctggaggaatttcacagcctctcaaactacggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttccttcctttctttttccttttttttttttttttttttttttttacaaagagccttcatgtttttatatatttcatagaaatttttatagcagttgcaggtaaactgtcaggattggttttaaaatatttttgtaactttaaaatattctataattatgcatgtgattttaacatttaatattcaaaaataaatctcttgctggatttgagagtattgcatttttaaagtctctcttctgtaactggatgttttggcaactttgtggggagagactgctggatttcttaaagcaacgtattcctgacactggccacagaatgcctttggaaatcggatgtactgttctcttgttcacgtttagtggtgttttgctgttttgttttttaaacaaatgatgctgagaataaggagagaaatgaatgtagagagaggtagagagagaaatatgaactctaacaaaggactgaggagtgcagtctgctggttcaggctcttcaaaagatgtagaaaaagagatagaaggaaccacctatgcttaaaatactgtaaatatgcagtgaggtttggcaaaatctattccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcatttggttggctttgtaccttgtaccttttttagccttggcttttgttgaactagaaccctcagcacatactgtgttgtacttttgtaaatgattttttaaatggaattttgcacataatacattgtaatactgtatgataatcatgtgtgaaaataatttttgaaatatcc

SEQ ID NO: 25530 - DNA, 1837 bp, Homo sapiens
gagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctagaagacaggcgggacttcccagtggtgcatccaaaggggagctggaagccttgccttcccgcttctacatgcttgagcttgaaaagcagtcacctcctcggggacccctcagtgtagtgactaagccatccacaggccaactcggccaagggcaactttagccacgcaaggtagctgaggtttgtgaaacagtaggattctcttttggcaatggagaattgcatctgatggttcaagtgtcctgagattgtttgctacctacccccagtcaggttctaggttggcttacaggtatgtatatgtgcagaagaaacacttaagatacaagttcttttgaattcaacagcagatgcttgcgatgcagtgcgtcaggtgattctcactcctgtggatggcttcatccctgccttcct

SEQ ID NO: 25531 - DNA, 1030 bp, Homo sapiens
gctgcataaggactgcccggggctgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgct

SEQ ID NO: 25532 - DNA, 965 bp, Homo sapiens
gctgcataaggactgcccggggctgcgcgccgggaacctcgcggggctggcgggcgccgcacccccctcccgagtagctaggactacaggatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgct

SEQ ID NO: 25533 - DNA, 3492 bp, Homo sapiens
gctgcataaggactgcccggggctgcgcgccgggaacctcgcggggctggcgggcgccgcaccccctccctggccgcctgcgccccggggaggccgcccgcgcgcgacgggaccggcagcatgagcagcggctacagcagcctggaggaggacgccgaggacttcttcttcaccgccaggacctccttcttcaggagagcgccccagggcaagccccgctccggccaacaagatgttgagaaagagaaggaaacccacagttacctcagcaaagaggagatcaaagagaaagttcataaatacaacttagcagtcacagacaagttgaagatgaccttgaattcaaatgggatttacactggcttcattaaagtacagatggaactctgcaaacctccacagacttctccaaattctggaaaactctctcccagtagcaatggctgtatgaatacacttcatatcagcagcacaaacactgtcggggaagtgatcgaggccctgctcaaaaagtttctcgtgactgagagccctgccaagtttgcactttataagcgttgtcacagggaagaccaagtctacgcctgcaagctctcagaccgggaacatccactctacctgcgtttggtagcagggcccagaacagacacacttagttttgttcttcgtgaacatgaaattggagagtgggaagccttcagccttccagaactacagaatttcttgcgcatcttggacaaggaagaagatgaacagctgcagaacctgaagaggcgctacacagcctacaggcagaagctggaagaagccctccgtgaggtgtggaagcctgattaaagcggggctccctgcccgtgaggcccggtgcaggaccgatgtacaaaacagcagcaagtgcctctcttctcagagggctgctgtcttgccccactatgctagggtcttcgcctttctatctgtagattttgttccccaaacctggtcacacagcatcctgcaccttagcgtcccatgtaagggactctgcaagcttgttgttcagcaccgcagtgttacctcttggcaagctgtgaacctgtcgcctcatcaggagcattcgagggtgcttggaagcatgaactctgggggtgtttttttttttggttattttaattatgtgatgatgctgttaagcttacagatatgcagttgattttttaaaaagcttaactaggaatctttctgaatacttgtcctattttgaaactacctgtctggttttttgtttggttttgttttctttttttaatgtcagaggaatctatccatgtgaatcgaaaggcacaggaatctaggaactctgaggaatttattgtgaaggattttgttagggggttgacagagaaagcaaagtgtaagtttggaagaaggcatgtgcggtggtggcgagtgctgcgggctatggaaggtgacttggcttttcagttaggggtagtggagaaaggggtagttgcttgtaaacgagttaaaagcattcagtgtggaggtgttaaacccattttaggatcgcttggtttcctggtgggtagaatatgggaacagagccagaggcaggagctaaaccaaaaggagggacccatgaactctgcagctgaccaatcagagaatcaggcaggtgtagcctactgacctgggcagaggtgggcctcacgcagctggatccgaccctttaattctgcccttttggagtggaaggtctgattggtgtagctgctctgcataggcaggacagtgacagttcactaactcttgttaagttacatagtgtatagctttccccccacaggtggttttcaaagttgagacggaatttgggtaggggcagctgtttttcccttgattgttagctaggatatttgtcaagtaaactttggtgacaatcactctcttcccttttattcctcctttccttttcctttcttcccttttttctttccttccctgctgtctcccaccctaccttgttcttttcctccctccctccctccctccctccctccctccctccttccctccctctctctccctctccctttcttttctacattgaaatctgttcttacataatagagaacagggctattgaataaagacccaatcctaccagatctttagttctaaagggcaacttgactgtgagtaggagggcccccaagaaagggaggaaagtccacacccagctaaccacacaacagggcttcattatggaaatattttaacaaaagtacatgttattaccaaccaaagagatgcatgtgcaatagaagccttccttaaaaacaggctaaataacctcattttatgcagcagtttaatctgagaacagagggaaaggtgtgcagtggttccagaggggccttatattctatttttagtctagatattttttgtttataaattcccaaggaattgttaacactttggtgacacctaatggattctttttgaaattccaaggtgcttcagttctttgcccaagtgaactgtgccttttattgcatttctgttcgtctcttggtggctcttctgactttttggagaatacccatcttgttggaggcagacttaagttgttatgctgtgccacacaatttactgagacaatcatatcttcctaagcatttaaggaaagttgaaaaaaatagaattagctataaaatatgtatggcacatcttgtttaattttgcatgtaacttctcttttgtacattgatgaggttttagtgacattgtcatccaacactttacctttattgttcagggaatgccttcgtgattttttgtactggttttattattcagactatggcctggatttgagtatattgttattaccacctggttttttaattattcatcccagtaaacttatattttgtgaagcatttgtttctcagattaagacactgttagaacctaaagtagtagctgatgggtatctgtgaattttttttttttttttttttttacttgaagtagattgtctgaataggcatcctcatctatatttacccaaaacctcgcttactgtcatgtgcactacaaattgcaatttggaaacctactgtattgaaattctgtcagtttatggttcttgaagactgatgtcctttcccaaacactggttactgcagcagcatttttaatgtgtaagtgaagaaaaaaggccactaaggccaaagattttttaagaatcattgtacaaatcattatgttaaactatctaagctttgctgtaatactgttttctcttcaatatgtgatggtacaggaaggatgttaaatgaaggggtggtattgcaggagagcattttaaatggcagaagtaaaaagttataatatttataattttgatgggtttaagtttatttttgtagggaagatttttctcccctaaaatagtttctagaatggcaaaattgtttccattattaaaaattgaagttattagtt

SEQ ID NO: 25534 - DNA, 5994 bp, Homo sapiens
ccaggatcgctgatcgcgtcgggggcactgcaagcgcccagctgagccatgctctgggaggagacaggcgccgcccctgcgcccgcgcgggcctcggacctcccctacaggtgagtgactcgcggagtcccagcccggcagagacagggcactggtttccctctaccagagttcctgacccagccgagaacaaaccgcgaagcaagttcagccgaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagtaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagccggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcacctataatgccagctactcgggaggctgaggcaggagaatcgcttgaacccgggaggcggaggttgcatgagccgagatggcgccactgctctccagcctggacgacagagcaagactccgtctctaaaaaaaaaaaaagagggaaataaacatttatttgtatattgttatgtagccattaaaattctgtttccaagtaattttaattacaggggtaaattcttatatatctaaataagaatatacacatacacatgttccaaaatatttattatgtacttaaggcatatatattatatatgtatgtgtgtgtatatatatatgtatttgtgtgtgtgaacactaatatttgcatatatatacacacaagaaataaaaacatgttaaaaatggctatatctgcattgtagaattatgagtgattcatgtttttctaacttccctatctgtattaagtgttctatagtttatatttgttactttttacatcaggaaatagtaaagttattatttaaaacttatgaacaaaaaagtaacaagcacatgcaagcacagagttctaccaaatgcaaaaaatttcaaatcaattattcaaatgagacattaacatcacttctgtggtagttttatatccataaagtctgattcttctcctttgaagagatgaagcttaatcttcctcatcctgaaaatgggctggacttagtgacttacgtctttttattttatttttaattgacaaataataattgtatgtatttatggggtacaatattatattattatatatgtatacattatggaattattaaatcaagctaattaacatatccataacctcttataatttctttgtggtgagaacatttaaaaatgtactcttttagcaattagggacttacttttaatacaggaaaatggaagagactgtgagactttgaagtaggtcataaaagtcactgtggcttcctccttgctctctcttggaccacttgctctgggggaagtcaactgccatgtcctgagcagccctggaaagacctacatgatgaagaactgagaccttctatcaaatgccagcagggaattgaggcctcctgtcaacagccattttagaagtagatcttccagcctcagtcaagccttcagatgactgcagccctgtctaatagcttgaccgtaatttcatgagagaccttcagccagaaaacccaaggaaaccattctggattcctcatcctcagaaactgtatgagataagaagtgtttgttgtagtacgccgctaaatttggggcaatttgttacatagcaatgtatagctcatacaatttctgggaaaaaaatagtttattttcgaatcatttttgcataatgcaagaatataaacttgtcacagaataatttatccttgttttaggtggtccaaatatttcattgtcagttatatattagctcaaattaaattttagataatatatattattattaatggtaaagaatgtgtcacatttatctttatagcttttctgtacctaatattgtgtcttgtgcgtaggatgtgctcaataaaaattgattgaataaataagtgaatgaaagaataaatgaatgagtgaaggaattatctgaaatatttttataaaattccccatatgtatgtattacttattacaagtctggtcccatagctgaaaaaatattaaacattatatatatata

SEQ ID NO: 25535 - DNA, 1360 bp, Homo sapiens
atgctctgggaggagacaggcgccgcccctgcgcccgcgcgggcctcggacctcccctacagaattcacttcctgtcctctggcctcattctggtcacaaggcaactgactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaa

SEQ ID NO: 25536 - DNA, 4331 bp, Homo sapiens
actgaggcacagggagtggctcaggtttcttgacacttccctgctgtggcgaaaaggagaaataattaacagctcctggggctccaggatcgctgatcgcgtcgggggcactgcaagcgcccagctgagccatgctctgggaggagacaggcgccgcccctgcgcccgcgcgggcctcggacctcccctacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagtaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagccggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcacctataatgccagctactcgggaggctgaggcaggagaatcgcttgaacccgggaggcggaggttgcatgagccgagatggcgccactgctctccagcctggacgacagagcaagactccgtctct

SEQ ID NO: 25537 - DNA, 2735 bp, Homo sapiens
ggcagagacagggcactggtttccctctaccagagttcctgacccagccgagaacaaaccgcgaagcaagttcagccgaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagtaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaa

SEQ ID NO: 25538 - DNA, 3661 bp, Homo sapiens
gcgccgccggcaggaggcgccgcggcacgcgcgggtctgggcgccggccccagccaacggcgggtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccgacgccatgcggtactcgctgtaccagtccccgcatctgctccttctgcagggctacagccagcagcaccctggtgtatgtgctcaaccgggaccggcacacggtgggccagcggaccccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccagccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgtt

SEQ ID NO: 25539 - DNA, 3689 bp, Homo sapiens
cccgccccgcccgttgcgccgccggcaggaggcgccgcggcacgcgcgggtctgggcgccggccccagccaacggcgggtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccgacgccatgcggtactcgctgtaccagtccccgcatctgctccttctgcagggctacagccagcagcacgacagcctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccagccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgttctta

SEQ ID NO: 25540 - DNA, 567 bp, Homo sapiens
ggaagcgggcagcgtgtgaacaagtgggcaccctctggtctggccaagggaggatgaccaaacggagagaaatgctttctgaaaatcccaaaacagataaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgttt

SEQ ID NO: 25541 - DNA, 3469 bp, Homo sapiens
gcgccggccccagccaacggcgggtgggagcagcgcgggaacgtggcggcgcggcgggttgtgccggaggtcacggcctccccacatcctttggctgaagcccacagtcctcatccatgaagcctcacccaccatgttttatgggacgcacttcatcatgtccccgcccaccaagagcaaactgaagcggcagagccagctgttgtccagcatgctgtcccggacgctgagctacaagtaccgggacctggactccaccttctccagcctgggcgccagcgatgaccccgccgagctctccacccagctgtcggcccctggtgtcctgaaggtgtttggggacagtgtctgcacaggaacccactacaagagcgtcctggccaccggcacctccagcgcccgtgagctggtgaaggaggcgctggagcggtacgccctggaccccaggcaggccggccagtacgtgctgtgtgacgtggtgggccaagccggcgatgctgggcagcggtggcaggcccggtgctttcgggtgtttggggacagtgagaagcccctcttgatccaggaattatggaaaccccgagaaggtttatcccggaggtttgagctgaggaagaggtcggacgtggaggagctggcagccaaggaggtggacaccatcacggcagggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccgacgccatgcggtactcgctgtaccagtccccgcatctgctccttctgcagggctacagccagcagcacgacagcctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactgctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccagccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgtt

SEQ ID NO: 25542 - DNA, 3083 bp, Homo sapiens
agatgcacaggctgccggctgccttgggaaggacggcggggctgctggcgctggtaagggtcttcctcagccagctgacgcctccctccatccggcttttgtttggttttattgggaatggttggaggaaaggccgccacagatggggatggatcttaacctgaaaggctgcgtacagggaactcagcagagggctcagaaaagacagcgccgggtcagctggggactgggataaacgcccaggcccggaggctgcagcggagtcgcgcgaagggaaccccgaccccggccctgggggatgcccggagctctcctccaccccggttgcgccgcacagtcagtgagaccagcctgagcccagtgaacgccctgcccgctgccgcccagggccccgaggagcccggccccgacgccatgcggtactcgctgtaccagtccccgcatctgctccttctgcagggctacagccagcagcacgacagcctggtgtatgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggtcctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaacccagccgtgggggctcccaggctggccccccgcacacggactcgtcctgcttgctcacgcctcccagcactccacttggccctgagcctggggaccccgactggccagagtccggcggcccctgtggaaaagcgctcccagagaggcagaggaacggactcagcggcctccggggtgcagctccggaaggagactctgcagcccttgcggaggagtcccctccagccccgtccagccgcagctccagcaccgaggacttctgctacgtcttcacggtggagctggaacgaggcccctccgggctggggatgggcctgatcgacgggatgcacacgcacctgggcgcccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgta

SEQ ID NO: 25543 - DNA, 2354 bp, Homo sapiens
atgtgctcaaccgggaccggcacacggtgggccagcggaccccctccagcaagcccagcatcagcctctcagcccccgacatcctgcctctacactgcaccatccgccggcaaccgctcccggacagcggccaggccgcggggaggctggctggagcccatccccggggcgcacatctccgtcaacttctccgaggtggggcacaggaccgtggtgctgcaccacggggacctgctctccctggggctctactacctgctgctattcaaggaccccgcgcaggcccagcccctgcccgcccgggccttggcgcgcctccgggctgtgccgcagagctgccggctgtgcggggccgcgctcggggcccggggagccgcctcccctactcaggccgccctgccccggcgccagcagctgctcctggagtttgagccccacctggaggacacgctgctgcagaggatcatgacgttgatcgagccggggggcgacgaccacaagctgacccccgccttcctcctgtgcctctgcatccagcactcggccacccacttccagccgggcacattcgggcagctcctgctcaagatagccaggctgatccgcgagactgtctgggagaaaaccaaagaactagcagagaagcaggcgcaactccaggagcccatctcgctggccagctgcgccatggctgatctggttccagacttgcagcccattcttttctggatgtctaactccatcgagctcctgtactttatccagcagaaatgcccactctacatgcagagcatggaggagcagctggacatcacaggctcgaaggaatcgctgttctcctgcacgctgacggccagcgaggaggccatggcggtgctggaggaggtggtgctgtacgccttccagcagtgcgtctactatgtctccaagtccctgtacatctgcctcccggcactcctggagtgcccgccattccagacggagcgccgtgagagctggtcctcggcccccgaactgcccgaggagctgcgccgcgtggtgtctgtgtaccaggcagccctggacctcctgcggcagctgcaggtgcaccccgaggtggcctcgcagatgctcgcctacctcttcttcttctccgggacactgcttctcaaccagctcctcgacaggggcccctccctgagctgcttccactggcccagaggtgtccaggcctgcgcccgcctgcagcagctcctggagtggatgcggagcgccggcttcggggcggctggagagcacttcttccagaagctctcctgcaccctcaacctgctggccacacccagggcccagctcatccagatgagctggacagccctgcgggctgcgttccccgcactgagcccagcacagctgcaccggctgctgactcactaccagctggcctcggccatgggccccatgagcacctgggagccaggggcccaggacagccccgaggccttcaggtcagaggatgttctggagtcctacgaaaaccccccacccatcgtcctgcccagcgacggcttccaggtggacttggaagccaactgcctggacgacagcatctaccagcacctgctctacgtccgccactttctgtggggtctgcggagcagagccagccccggcagccctggcaggcctggcagtggggcctcccagccagtgtgccccgagggtatgcaccacgtggtccttgacgggcacctggaggccccgagctgccccctggctcccagggaccctggcccagcagcccgggaagtggccccggagcgtactcttcccttgaggggggctccctgggcacaggccccccctggaaggcaaccccccgggctctacatccagaccctgctcccgggcagccccgcagcggccgacgggcgcctgtcgctgggggaccgtatcctggaggtgaatggcagcagcctcctgggccttggctacctgagagctgtggacctgatccgtcatggcgggaagaagatgcggttcctggtcgcgaagtccgacgtggaaacagccaagaagatccatttccgcacgccccctctctaggggggctgcgaggacacccccacaggcccggcacccggtcccacctggtgacactgggcttcctcccgccttcgtccctgttttgtaactgaccaagttgggtcccgggtggggagcctcaccctggggacatgcctgttgataacatgcatctcagtgtaggttctatttatatggcagatgacgtgaaattgtgatgtttgttacagagcttttatgtttaaagacttcaatggagaagtacggttcaataaactatttttcccgtt

SEQ ID NO: 25544 - DNA, 1404 bp, Homo sapiens
agagcaagcggcctgtgcccagatcctgggagaaccccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattc

SEQ ID NO: 25545 - DNA, 5023 bp, Homo sapiens
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccctacaa

SEQ ID NO: 25546 - DNA, 4528 bp, Homo sapiens
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctatatcctgatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccct

SEQ ID NO: 25547 - DNA, 4375 bp, Homo sapiens
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctatatcctgatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctgaggaactttacactgaccagctttaaaacagtactttaaaaggaaaagcctgttactgtttatttacctaaaagattcctaatgtgcagcactgttttctctttcagttagttgactcaaagggggaaaactaaagaatgcaaaacttttgctattcataccactgatgttcatcaaaagtatgcgatctaaaacatgactatcatttcctgacaatggggcatctcggtggcctgcctggctgattcttccttaaaactaaaatctctggaaaatggatttgcttcttaccctgtgttttctgcaaactgacttactttgttccagccaaagcttgctaataatagaaaactacccatattccaaaagtagatttcctctgtatcccagcatactttgtgaacctggctccttcttcactacctcagatctaatcaattagtccatgtaccctccttcctcactacagtcataacacatgagcatatctacctagaagccaatttctactgatgtagccacaactttttagaggcctattaaacatgacgttatccaattgcaggtcaacttatagttgtagccttacaacttacaggcatcagaaaataagtaatcaaattaggtacctggaaacatagctattaccatctcatattactgtctaattaaaataaacataacgcaaacatgtttgtccttatatattctacagtggatagaattaggaattgatggcttaaaaaaaaaagtctatgaagagtctgtttaactcttcatgttccatctttctcttctgaagtaaactattttgaaagttctctttttgaaatgaatttgtgcttaactgtcttcactattaatactatttagaaataagctaattggatcagtggcttaaataatagctgactgtgtgtacatatgtatataatatgtatatacaatatcaggcatgcatgtggcttggaattttgtttcctccataaaatgtggaagtgaattaaacaagttttagtcatttatacaaagtcacaaatataaagttcagtttgtcacaagattaaattgctcacaaggtaaaattgtattgtttggcaaaatcacaagtaacaatcctgtgagttttctattatgaaggttaataataaatgggctcatttagttgcctgggcacctattcacaaattcatttgtcagcctctttttagttctcttaaaaaaaaaaaaatcatatgatcattttcctttttgggggtacttagcttccatgcctataaagtctggtaccagactgacttgaaattcataaacaagttgtccaattgccaagaatatgttaacaattaaaagttccaaactaaagccaatagcaccaagtcttcataagaatacaaagtatacatacagtattgcttacctggaggattcagatcatttaggaattctctttgatgaaagatcagttcccatttgagttcctccttgcactgagttttagtgatatagaactagcttgtagttagtgtttcattacattataaagaatagttttacacacgtatttaccgttttccaaatttaaactcagaaatacccaaagcaggcctgcttaagcccactacctggcatataaacttatagtaacactttgttactttctttttaataggacaagcatgagttaggacaaactctaaaaattcatattcttcactattcttgttttcctttgattgatatagaccaaagatggtgtactctaattttttaaaacagtaatggaacacaatttttttcattcttcctcctctccattcgaagtaaagatccccagttagtttttatataaataatctatagggattcaaaaggtgtcacagtccacttaattagtcaaattagcaatggctaaacagtatcaagtactgcagaatttatcactgaaatggataagaggaaatagtttagtcacaggtttttacagtccagcaagggccaaagaggtatagtatacaagttaatagtatttgtgttgagcaacatggggctagtgggatcacagaaatctggaaaaaaaaaaaaaaggctttggcttatcaagcctagtgtaaatttctgcatctcacacgactttagtttggccaggtatttatctgccaaaacaaggacaaatcttgttgtattaacagcagggtcacttctcattttctttgctgacttacctttttactgaccgttgtgaatttctgtctcaaaatgtataatatagaaatgcaagaaaaaaacaaatgtacagattgtaaagttttttgatacctaatgtaagttttctttgtgtaatatttatatgataaaagacattaggatccct

SEQ ID NO: 25548 - DNA, 2296 bp, Homo sapiens
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 25549 - DNA, 2574 bp, Homo sapiens
gcgtctgggccagatatggatcacgcctgtggagcgcacctccacacaggcagccctcgtccaaggtgcagggcgcagggcacagggcacatgtctacggcccagtcctgcagacggctacctagagaccccagggcacaggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccaccactaacaccttcaaagccaccagtagtagtggactgggcttctggagtgtctcccaaacctgatccaaaaaccattagcaaacacgtccagaggatggtggattctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatgcacctgaggaaggaccttttacattccctaatggggaggctgtggaacatggtgaggagagtaaggatcggaccatcatgctgatgggagtgtcctcacagaagatttctcttcggctgaagagggctgttgcccacaaggccacccagactgaatcacagccttggattggcagtgagggcccttcaggtccctttgtgctgtcttccccaaggaagacagcccaggatactctatatgtgcttcccagtcccacctctccatgtcctagcccagtcttggtcagaaagcgggcttttgtcaagtgggagaataaagactccctcataaaatcaaaggaggagctccgtcacctcagactgcctacctaccaagaactggaacaggaaataaatactctgaaagcagataatgatgccctaaagatccaactgaaatatgcacagaagaaaatagaatccctccagcttgaaaaaagcaatcatgtcttagctcaaatggagcagggtgactgttcttagcccagaaactaagtagcacaatctgtagatgagtatagtgatctcatttcctaaactgtaatgcacagacctga

SEQ ID NO: 25550 - DNA, 1621 bp, Homo sapiens
acaaagtttgtgcctgcggtgcacctcggtcgggctcgccgggctcgagggctggcgggcgccggggctacgaggcccgggggggagagagccggcaggcggcggcggtggtggcgggggcgatgcgccgcgcccggccgcgctaggtgagccggcaccgggagcgcgggccgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctatatcctgatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagaagtggggcc

SEQ ID NO: 25551 - DNA, 1757 bp, Homo sapiens
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaaggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 25552 - DNA, 1910 bp, Homo sapiens
cgcggccatgggcaccctgggcaaggcgagagaggctccgcggaaaccttcccatggctgcagagctgcctctaaagcaagactagaggcaaagccagccaacagccccttcccctcccatcccagcttggcccacatcacccagttccgaatgatggtgtctctgggacatttagccaaaggagccagcctggacgatctcattgacagctgcattcaatcttttgatgcagatggaaacctgtgtcgaagtaaccaactgttgcaagtcatgctgaccatgcaccgaattgtcatctcctctgcagaactgctccaaaaagttatcaccctctataaggatgctttggcaaagaattcaccaggactttgcctgaagatctgttattttgtaaggtattggataacagaattctgggtcatgtttaaaatggacgccagcttgacagacactatggaggagtttcaggaactggtgaaagctaagggtgaggagttacattgccgcctgattgacacaactcaaatcaatgcccgtgactggtccaggaaacttactcaaaggataaaatcaaataccagcaagaaacggaaagtctccctgctctttgaccatctggaaccagaagagctatccgagcacctcacctaccttgagttcaagtctttccggaggatatcgttctctgattatcagaattaccttgtaaatagctgtgtgaaggaaaaccccaccatggagcgatctattgctctgtgcaacggcatctcccagtgggtacaactgatggttctcagccgccccacgccgcagctccgagcagaagtcttcatcaagttcatccaggtggctcagaagctccaccaactacagaacttcaatacactgatggctgtgataggtgggctgtgtcacagctcaatctcgaggctcaaggagacaagttcgcatgtcccacatgaaatcaataaggttctcggtgagatgactgagctgctgtcctcctccagaaactacgacaattaccggcgagcctatggagagtgcaccgacttcaagatccccattctgggtgtgcatctcaaggacctcatctccctgtatgaagccatgcctgactatctggaggacgggaaagtgaacgtccataagctactggccctatacaatcatatcagtgaattggtccagctgcaagaggtggccccacccttggaggctaacaaggacttggtacacttgctgacgttatccctggatctttactacactgaggatgaaatctatgagctttcctatgcccgggaaccaaggaaccacagagctccatctgtcttcaagaactatgatcacgaccaggatggatacatttctcaggaagaatttgaaaagattgctgcgagttttccattttccttctgtgtgatggacaaagacagggaaggcctcatcagcagggatgagatcacagcctacttcatgagagccagctcaatctattccaagctgggcctgggctttcctcacaacttccaagagaccacctacctgaagcccactttttgtgacaactgtgctggatttctctggggagtgatcaaacaaggatatcgatgtaaagactgcgggatgaactgtcacaaacaatgcaaagatctggttgtgtttgagtgtaagaagcgagccaagaacccagtagctcccacagagaacaacacttctgtggggccagtgtccaacctttgctcattgggagccaaagatctgctccatggaaataaatactctgaaagcagataatgatgccctaaagatccaactgaaatatgcacagaagaaaatagaatccctccagcttgaaaaaagcaatcatgtcttagctcaaatggagcagggtgactgttcttag

SEQ ID NO: 25553 - DNA, 2310 bp, Homo sapiens
cgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 25554 - DNA, 2983 bp, Homo sapiens
gttgctaatggtgtcatgcacccaccggccacccttggcgcgagcgcccccctctggacaccctgctccgtgcgcgctcacagttcgcctgtgcggggccggggccagggtcaggagccggggatagggaggaagagggcctgtggacaagctgagccgggacccctgggacctttgcggaggtggcctgggagcgctcagttcccaggctcaggcttcccgctgacgcctcctggccgcagcgggctccccccgccccaggaatgttcctctcccatccagtccgcctcccctagggcaggccccctgggggctgccgcagccccgcctcgccttcctgggctcccgggagggggcgaggcgggcaggacgcctgggttctctccccccacctcccataccagggagaaattcctccgaggtcccctcaggctctgggttcccaaaataaccctgcgggggaagggaggctgtggagggagggaagcgggaggggcgcagagccgagctgcggggtgctgcaggtgcctctggggagagggcgcgaggagaaggcgccctgcggggggctgggcgccagccagtcctgggatcttggttcgtccccatcctcgtgaagcccctcggccttcccgcgactccgagggtgggccggaagcctctctgcgggtccgtttcccaactggcgggttgcaccatcccgggccagaccgtttaaccccgggagtggccgcgggggacaactccgcccctgtccagcagggggcgtgcccgccccgccccgtttctgcccgcggggccgctcccccgcccgcgactccgcagactcccgctctgcctctcccgggacaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagcagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 25555 - DNA, 2221 bp, Homo sapiens
cgggagccgcagccgcagcgaggccggcgggcgggagcgcacggaggtggggtcggccaggccggtgcgggctccttgcggcaggtcccaagagggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 25556 - DNA, 2304 bp, Homo sapiens
gtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctgtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggagaagctgctacagctgcagaacttcaacacgctgatggcagtggtcgggggcctgagccacagctccatctcccgcctcaaggagacccacagccacgttagccctgagaccatcaagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgtctctggatcagtatcagacggaggatgagctgtaccagctgtccctgcagcgggagccgcgctccaagtcctcgccaaccagccccacgagttgcaccccaccaccccggcccccggtactggaggagtggacctcggctgccaaacccaagctggatcaggccctcgtggtggagcacatcgagaagatggtggagtctgtgttccggaactttgacgtcgatggggatggccacatctcacaggaagaattccagatcatccgtgggaacttcccttacctcagcgcctttggggacctcgaccagaaccaggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctgatcctgggcatctacaagcagggcctcaaatgccgagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccagagatccgtgaggaggaggtacagacggtggaggatggggtgtttgacatccacttgtaatagatgctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttca

SEQ ID NO: 25557 - DNA, 659 bp, Homo sapiens
acatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcgatgactccgggaaggtgcgggacccgcagctggtgcgcatgttcctcatgatgcacccctggtacatcccctcctctcagctggcggccaagctgctccacatctaccaacaatcccggaaggacaactccaattccctgcaggtgaaaacgtgccacctggtcaggtactggatctccgccttcccagcggagtttgacttgaacccggagttggctgagcagatcaaggagctgaaggctctgctagaccaagaagggaaccgacggcacagcagcctaatcgacatagacagcgtgtgcgtgggggagcacagagggctgggggggcactcagtatcctataccatctgtgcttaa

SEQ ID NO: 25558 - DNA, 2927 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 25559 - DNA, 3313 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcggggtgagtggggtgtcagtgagtgggagggaagccttggcccgcaggctggaagaatggatgacacagatcggacccctgccgctgccttcccccagagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 25560 - DNA, 2651 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 25561 - DNA, 2942 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaagctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 25562 - DNA, 3217 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgg

SEQ ID NO: 25563 - DNA, 3061 bp, Homo sapiens
gctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggccctcctggagctcactgagctccttgcctcccacaacaactacgcccgctaccgccgcacctgggctggctgcgcgggtttccggctgcctgtactgggcgtgcacctcaaggacctggtgtccctgcatgaggcacagcccgacaggttgcctgacggccgcctgcacctacccaagctgaacaacctctacctgcggctgcaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctggagaa

SEQ ID NO: 25564 - DNA, 3011 bp, Homo sapiens
atccccgtgtgggggaggggggccttcggtctctccccagcctcttccttccccctggcctgagggtgggtggggaggggcagttcctctttccttcccaagcaccgaggaggccccagctccctaggggctgagaagctggagtcctgggcaaggggaggagctgagccctactcttgcaagacccccggcctcctcaccccacgcgggaagcatgaacagaaaagacagtaagaggaagtcccaccaggaatgcaccggaaaaataggagggcgaggccggccccgccaagtgcgccgccacaagacatgccccagccctcgggaaatcagcaaggtcatggcttccatgaacctgggcctgctgagtgagggcggctgcagcgaagatgagctgctggagaaatgcatccagtccttcgattcagctggcagcctgtgccacgaggaccacatgctcaacatggtgctggccatgcacagctgggtgctgccgtccgccgacctggctgcccgcctgctgacctcataccagaaggccacaggggacacccaggagctgagacggctgcagatctgtcacctggtcaggtactggctgatgcgacaccctgaggtgatgcaccaggatccccagctagaagaagtcataggtcgtttctgggccaccgtggcccgggagggcaactcagcccagagaagactgggagactcttctgacctcctgagccctggtggccctggccccccactcccaatgagcagcccaggcctgggcaaaaagcgcaaagtgtccttgcttttcgaccacttggagacgggggagctggctcagcacctcacctacctggagttccggtccttccaggctatcacgccccaggacctgcggagctacgttttgcagggctcagtacgaggctgcccggccctggagggctccgtaggtctcagcaacagcgtgtcccgctgggtgcaggtgatggtgctgagccgtcccgggcccctacagcgtgcacaggtgctggacaagttcattcacgtggcacagaggctccaccagctgcagaatttcaacacgctgatggcagtcacagggggcctgtgtcacagtgccatctccagactcaaggactcccatgcccacctgagccctgacagcaccaaggagctggtggccctccaagggcagcatccaccctgcagcgccaatgaggatctgctgcacctgctcacgctctccctggacctcttctacacggaagacgagatctatgagctttcttatgcccgggagccgcgttgtcccaagagcctgccaccctcccccttcaatgcacctctggtggtggagtgggcccctggtgtgacacccaagccggacagggtcacactgggtcggcatgtggagcagctggtggagtctgtgttcaagaattatgaccctgaaggccgaggaacaatctctcaggaggactttgagcgactctcgggcaattttcccttcgcctgccatgggcttcacccacccccacgccaggggagaggatccttcagcagagaggagctgacagggtacctgctccgggccagcgccatctgctccaagttgggcctggccttcctgcacaccttccatgaggtcaccttccgaaagcctaccttctgcgacagctgcagtggcttcctctggggtgtcaccaagcaaggctaccgctgtcgggagtgcgggctgtgttgccacaaacactgcagagaccaggtgaaggtagaatgtaagaagaggccaggggccaagggcgatgcaggaccccccggagctcctgtcccatccacaccagctccccatgccagctgtggctccgaggaaaatcactcctacacgctatccctggagcctgagactgggtgccagcttcgccatgcctggacccagactgaatccccacacccttcctgggaaacagatacggtcccctgcccggtgatggacccaccatcaactgcatcctccaagctggattcctagacatctcttggtctcctctcttcctcactcccttcccccagtcagtcctgagtcctgccgtcagactctggcagggctcccagaggtaggcctccagaggcatccgccttcccatccacactgcctttagtggtacgtccgtcatctttttccctggaagtgactttcctcttttgcatcctggtggatgctaatcctgctccctttccctgcacttagtatctgtgcggctgtgtgttggatacatttagactcaggcctcattctaccaactccctacatctccatttctttttttttttgagacagagtcttgctctgtcacccaggctggagtgcaatgatgcaatctcagctcactgcaacttccgcctcctgggttcaagtgattcttctgcctcagcctcccaagtagctgggattacaggcacgcgccaccatgcccggctaatttttgtatttttagtagagacggggtttccccatgttggccaagatggtctcaaactcctgacctcatgatccaccagcctcagcctcccaaagtgctgggaatacaggcgtgagccaccacgcccagctcctgtttttctgcatagaatgtgctccctctgacagcctatactttttccctctttatctcgttgaacgtctgtctttcctcaacaggagcatcaactccaggagaacagggatttctatcaatgtcattcactgctgcatccccagtgcctagaacagggctggcaggtggtaggcgcctgacagatgcttgtctgatgcctgaatgtctccttacccatgcccacggcacaggatagatgtgctatagggcaaagaactttgagggtcgagcagcaggggcccattcagtcccagggagcagagacccccccaaccccttcacaaaccccaacacccctgacttggcccccacagagagaggtcctacagctgtcataaattaaatttattctctgga

SEQ ID NO: 25565 - DNA, 3090 bp, Homo sapiens
gccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 25566 - DNA, 3213 bp, Homo sapiens
gccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 25567 - DNA, 3309 bp, Homo sapiens
gccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttccatgcccggttacgctgtatgtgcacctgcaacaggtgtacattttgcatctgtcagaacttcctcaactcagacttgctgcaatctgtaaagaacaaaatcttcactgcagttcttaacaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 25568 - DNA, 3186 bp, Homo sapiens
gccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctcctcaagctctggaggatgtcaagaatgtagtcagaaaacatataagtgatggtgtggctgacagtgggttgaccctgaaaggttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatttatttctccaaagcacctttgacaagcatgatttggatagagactgtgctttgtcacctgatgagcttaaagatttatttaaagttttcccttacataccttgggggccagatgtgaataacacagtttgtaccaatgaaagaggctggataacctaccagggattcctttcccagtggacgctcacgacttatttagatgtacagcggtgcctggaatatttgggctatctaggctattcaatattgactgagcaagagtctcaagcttcagctgttacagtgacaagagataaaaagatagacctgcagaaaaaacaaactcaaagaaatgtgttcagatgtaatgtaattggagtgaaaaactgtgggaaaagtggagttcttcaggctcttcttggaagaaacttaatgaggcagaagaaaattcgtgaagatcataaatcctactatgcgattaacactgtttatgtatatggacaagagaaatacttgttgttgcatgatatctcagaatcggaatttctaactgaagctgaaatcatttgtgatgttgtatgcctggtatatgatgtcagcaatcccaaatcctttgaatactgtgccaggatttttaagcaacactttatggacagcagaataccttgcttaatcgtagctgcaaagtcagacctgcatgaagttaaacaagaatacagtatttcacctactgatttctgcaggaaacacaaaatgcctccaccacaagccttcacttgcaatactgctgatgcccccagtaaggatatctttgttaaattgacaacaatggccatgtatccagaggatcattacagagacagactctcccgagacatgggccacactgatagaatagagaatttgagaaaaatctgggtctttctaaaaactgctttgcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttctatatcaggctaggataacctagaggcagtaattttttaaatgataaaataaatctaatgaatataaactctcatgataaacctattttttccatcatcagccttttcaagtatttaaataaataactgctgtgtactgtga

SEQ ID NO: 25569 - DNA, 983 bp, Homo sapiens
gccgccgccgccgccgccgccgccgccgccgccgccgccgccgccgccacagcccgctgggccggaggaggcggagctggcgctgtcccggctctcttgcggggaagcaactgagggggcggcgcggcgggccccggcggccgaagaggctggcaggtggcgccgtggggtgggtgctcctggtgagaggagtccactccgtgcgtgcgggcggaggccggcccccgagagccgccgacatgaagaaagacgtgcggatcctgctggtgggagaacctagagttgggaagacatcactgattatgtctctggtcagtgaagaatttccagaagaggttcctccccgggcagaagaaatcaccattccagctgatgtcaccccagagagagttccaacacacattgtagattactcagaagcagaacagagtgatgaacaacttcatcaagaaatatctcaggctaatgtcatctgtatagtgtatgccgttaacaacaagcattctattgataaggtaacaagtcgatggattcctctcataaatgaaagaacagacaaagacagcaggctgcctttaatattggttgggaacaaatctgatctggtggaatatagtagtatggagaccatccttcctattatgaaccagtatacagaaatagaaacctgtgtggagtgttcagcgaaaaacctgaagaacatatcagagctcttttattacgcacagaaagctgttcttcatcctacagggcccctgtactgcccagaggagaaggagatgaaaccagcttgtataaaagcccttactcgtatatttaaaatatctgatcaagataatgatggtactctcaatgatgctgaactcaacttctttcagaggatttgtttcaacactccattagctccacgttttggcttcgagcaagttttggtgctactgtttttgcagttttgggctttgctatgtacaaagcattattga

SEQ ID NO: 25570 - DNA, 2539 bp, Homo sapiens
gacagcgcggggccgagaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatggacaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaa

SEQ ID NO: 25571 - DNA, 4372 bp, Homo sapiens
gggctccacggagtgaataggaggcggctcaggcttcctggctcgcgtgggcgccagaaagcggaacctcccgggccagtcgcgcggtggtcaccctcttgggagctggggaggaggctgcggaggctggcccggctccttcgggcgtcgcttcccggaccgggtgcgcggggtcccccggaacgtgtgttccaggtcctcccgcgccagtgttcgcagtccccgcctggtcgcggcggcgcctcgggcgcgggtgcaggcgcgcggcgcgcaggcggggggcgctgtggtcttggcgcggggaccgagccgctcggccagacccgcctcttttccctccccgccagcccgcccgcctgcccgccccccacgcgtcgtgtcgccgggaagccgggcggagacagagcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaatataa

SEQ ID NO: 25572 - DNA, 3301 bp, Homo sapiens
caaccctacccagatctcctcccccaggcctggtctcctcacaggacgccccctccccgctcttcctgccgggtttcctcttgccttttcctgtcccccacccagtgctgggagccgtggcagaggcaagagcagtggaactgacccaggccagtggagccagggcctccgggtgtgccggacccgaagcaggggccatgctgtctggtgaacggaaggagggcggaagcccccgcttcgggaagcttcatctccccgtgggcctgtggatcaattcccccaggaagcagctggcgaagctggggcggcgctggcccagcgcagcctctgtcaagtcttcttcgtcggacacggggagccgcagcagcgagccgctacctccgcccccgccgcacgtggagctgcggcgagtgggcgctgtcaaggcggccgggggagcctccggtagccgcgccaagcgcatctcccagctcttccggggctcggggaccgggaccacggggtccagcggcgcaggaggccctgggaccccggggggcgcgcagcgctgggccagcgagaagaagctgccggagctggcggcgggcgtggcccccgagcccccgctggctacccgcgccacggcgcctccgggggtcctcaagatcttcggcgccggactggcatcgggcgccaactacaagagcgtgctggccacggcgcgctccacggcgcgcgagctcgtggccgaggcgctagagcgctacggcctagcaggcagccccggcggtggccccggcgagagcagctgcgtggacgccttcgctttgtgcgacgctctgggccggcccgcggcggcgggcgtgggaagcggcgagtggcgggcggagcacctgcgcgtgctgggcgactccgagcgcccgctgctggtgcaggagctgtggcgggcgcggcccggctgggcgcggcgcttcgagttgcgcggccgcgaggaggcgcggcgcctggagcaggaggccttcggggccgcggacagcgaaggcaccggcgccccttcgtggcggccacagaagaaccgctcccgggcggcgtcgggtggggcagcgctggccagtcctggcccggggaccggatcaggggccccagctgggtctggaggcaaggagcgctcagaaaacttgtctttgcggcgcagcgtgtcggagcttagccttcaggggcggcggcggcggcagcaggagcggagacagcaggcacttagcatggccccaggggcagccgacgcccaaatcggaactgcagaccccggggacttcgatcagttgactcagtgcctcatccaggcccccagcaaccgcccctacttcctgctgctccagggctaccaggacgcccaggactttgtggtgtatgtgatgacgcgagagcagcacgtgtttgggcgaggtgggaactcgtctggccgcggggggtccccggctccctatgtggacaccttcctcaacgccccggacatcctgccgcgtcactgcacagtgcgcgcgggccctgagcacccggccatggtgcgcccgtcccggggcgccccagtcacgcacaacgggtgcctcctgctgcgggaggctgagctgcacccgggcgacctcctggggctgggcgagcacttcctgttcatgtacaaggacccccgcactgggggctcggggcctgcgaggccgccgtggctgcccgcgcgccccggggccacgccgccaggccctggctgggccttctcctgtcgcctgtgcggccgcggcctgcaggagcgcggcgaggcactggccgcctacctggacggccgtgagccagtcctgcgcttccggccgcgcgaggaggaggcgctgctgggcgagatcgtgcgcgccgcagccgccggctcgggagacctgccgcccctcgggcccgccacgctgctggcgctgtgcgtgcagcattccgcccgtgagctggagctgggccacctgccacgactgctgggccgcctggcccggctcatcaaggaggccgtctgggaaaagattaaggaaattggagaccgtcagccagaaaaccaccctgagggggtccccgaggtgcccctgactcctgaagctgtgtctgtggagctgcggccactcatgctgtggatggccaacaccacggagctgcttagctttgtgcaggagaaggtgctggaaatggagaaggaggctgaccaagaggacccacagctctgcaatgacttggaattatgtgatgaggccatggccctcctggatgaggtcatcatgtgtaccttccagcagtctgtctactacctcaccaagactctctattcaacgctgcctgctctcctggatagtaaccctttcacagctggtgcagagctgccggggcctggcgcggagctgggggccatgcctccaggattgagacctaccctgggcgtgttccaggcagccttggagctgaccagccagtgcgagctgcaccctgacctcgtgtctcagacttttggctacttgttcttcttctccaacgcatcccttctcaactcgctgatggaacgaggtcaaggccggcctttctatcaatggtcccgagctgttcaaatccgaaccaacctggacctcgtcttggactggctacagggagctgggctgggcgacattgccactgagttcttccggaaactctccatggctgtgaacctgctctgtgtgccccgcacttccctgctcaaggcttcatggagcagcctaagaaccgaccaccccaccttgacccccgcccagctgcaccatctgctcagccactatcagctgggccctggccgcgggccgccagccgcgtgggaccctccccctgcagagcgggaggctgtggacacaggggacatcttcgaaagcttctcctcgcacccgcccctcatcctccccctggggagctcgcgcctgcgcctcactggtccagtgacggacgatgccttgcaccgtgaactccgtaggctccgccgcctcctctgggatcttgagcagcaggagctgccagccaattatcgccatgggcctcccgtggccacgtctccttgagaaccaataccaaacgagcgcgcgaaccttgaaatgtcacgggcttctacggacaggagcccgcctgagcgcaaagctttctgggagttgtagttcttatcccgcgtggaatgttgggagattgagttttcgggaagtagcggatgggacggtgggagcatgggcttaggatgtgaatgccagggagcaataaaggtatccgtggtatcggc

SEQ ID NO: 25573 - DNA, 5614 bp, Homo sapiens
aggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctgaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccactttaaaaaagaaaaaaaataagaagtgtttttcctttggtccatcagtcattacaggttccattcaagacagtgatagaaactttagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacatctcttcaaaaagaaagtaaacagggaatgaaggtggtgggaaaatcacttcacttcacccactatttcatgttgtaataagggccaccataaggatgccctcctcatagtgttcggttctgatcttcctcgagaacagtcacttggcgcactttaataatctggactgctccagatttgactttagatactccatggtatctagtctttatgatcagttgaatgatcagtgtttaagtctaaaaataatgctttcctgaaaatgtttatatttcattgctgtttccttattgcctgctagccaaatggaatttgggcaagcaactctttgaagacttttttaccctagaaatttacttttgtcctaaaaaccctaactgtaaataagcagtcgaagcaagttgccaccttgaagttgagggatacactttgcttcatcagtattaaaaaccatggtactcttattttgtcttttttaattcaaaacattttctaaatgtggtactttgaaccttggagtatttacatgtttctgttcaaaactgtgacttattaatgtaagtctgctagtagtactttttttgtctgagcataagctatatttcaagatatactttgccaattttgttattggtgggtaatcatttttaaattatattgttattaggtaattatttttaaagactactggcatacaatcaaagttgttccataaaagaatataactgagcaatgtatttctctaaatgacttgtaaaaatcaatgaattatgtttaagtctgcattatggtaggttattactcccagctcattttaaagacaagtttgaaagagtcctttaaattttataagcttgtagattccataaactacactgatttatacatttgaaagaatttagccatttaataaatttcttattctcaaattgcatttagattaaaattccttttaagagtgtctgaaatgtctgcctgcgaagaacatgtaaacattgccagataccagtcattattctttagtggctttttagtcctctgcttttttttttaaggcaaaagaaatatgcatctagcatttctaataccaaatccccaattgtgattgttttaaagatcatggtatgatcacagggaccaaggctgtgtgcatatataactctggatttgaaaggaggagagttcagccatctagttcttttcttcacatgacacttttaaacagccagtttgactggaattaaccaacttggcacagcctaaaaaaggagtaatgtgaaattaaattatttttctttgaaagtcttttgaaataagagaccatgtaagtaggaccctaagacaaccaaggaatttgcttccagggccctcattcctctgctgttacttacaaatgttttaatttttactacctgatattctttctctaccttttccacatttgaaaatatacaaggcagctcacttcatcctaaaaacctaaaaactccaggaaggaaagaaaaggatgatatggggaaatttgccataaatgccggttctggttcttagtttagccatttccatcagttgaaattgtggtgtgatctgttgcttgtttcgttgttgttttgtttttgtgtagctttgttttttaatattcatttaataagatgatgggcaatagcaaacatttttactcccaggaatataatttatcaaattgaactattttatttgccaaagaaacttgtttttaatatcacgggtaatgggtaagtgtgaaaactaggcttttttttatgaaacaaaaaaaggtgacgaataatatggcttttgtttctgtttctgaagcctgatttcatttatgccaggttttgaaaaacagatctttttcttaagtgaaagcacctttaatttgctctaacggtacatcctgtaaagacagaattctgcatagccttttaggtgtttttacagtatgtgaaaaatacaagactcattctagagttaaattaccaatcttggttgatattatctgcttccatttttattaatttggaaattaatatgttgctagtaaatattggtttttacagtacccagtttgaaaatgtaagttatcaaaacttaatgtagtgaatttgtgtaaccatgttgtattgttgagaatgtatttttatttaaattttattttcttatcaagagtattataaaaattaacttttgtaactgtcgcttggaaataactcaaataaattacaagaagcctg

SEQ ID NO: 25574 - DNA, 2119 bp, Homo sapiens
aggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggtagttgtgtttatgctttattgtggggtttttcctggttctcagtgaaggtttctttgccgcttattgtgactctagtgaatcctttcagtaatattactgtagtttatggtttctcacactgatacatacgtactaagaatgaaaaaatatttgacagtaaccccatgtatattatgtttttctcacattaaatttcttgagtttctg

SEQ ID NO: 25575 - DNA, 3054 bp, Homo sapiens
aggcggcagggctgcggcacgggccgggcggcaccatggcggcggcggcgcctgctgctgcggcggcttcttccgaggcgccagcggcgagtgcgactgcagagcccgaggccggggaccaggacagtcgcgaggttcgagtgttgcagagcctgcggggcaagatctgtgaagcaaaaaatttattgccatatcttggaccccacaaaatgagagattgtttctgtaccataaatttggaccaggaagaagtttatcgtacccaagttgtggaaaaatctttaagcccatttttcagtgaagaattttactttgagattccaagaactttccagtatttgtctttctatgtttatgataagaatgttttacaaagagatctccgtataggaaaagtagccatcaaaaaagaagacttgtgtaatcacagtggcaaagaaacttggttttcattacagcctgttgactccaattcagaggttcagggtaaagttcaccttgaattaaaactgaatgaactgataacggagaatggaactgtatgccagcagcttgttgtacacatcaaggcatgccatgggttgcctctcataaatggccaaagctgtgacccttatgcaacagtttctctagtgggcccttctaggaatgaccaaaagaagacaaaagtaaagaagaaaacaagcaatccgcagtttaatgaaatcttttattttgaggtaaccagatccagtagttacaccagaaagtcccagttccaggtagaagaggaggacattgaaaagctagaaatcaggatcgacttgtggaacaatggaaacctagtccaagatgttttcctaggtgagattaaggttcctgtgaacgtattaagaactgattcctctcatcaagcctggtacttgctacagccaagagacaatggaaacaagtcatccaaaactgatgacctggggtctcttcgattaaatatatgttatacagaagactacgtgcttccttcagagtactatggtcctttgaaaactttgctgctaaaatcaccagatgttcaaccaatatctgcctcagctgcttacattttgagtgaaatatgtcgagataaaaatgatgctgttttgccccttgtacgactgctgctgcaccatgataaacttgttccttttgccactgctgtggctgaattagacttgaaggatacacaagatgcaaacacaatttttagaggaaattccctggctacccgatgtctggatgagatgatgaaaatagtgggagggcactacctgaaagtaacattaaaacctattcttgatgagatatgtgactcctcaaaatcctgtgaaatcgatcctattaaattgaaagagggagataatgtagaaaataataaggagaatctgcgctactatgtagacaagttattcaatacaattgtaaaatcaagtatgagctgccccactgtaatgtgtgatatcttttattctctaaggcagatggctactcagagatttcctaatgaccctcatgttcagtattctgcagtgagcagctttgtatttcttcgtttctttgctgtagccgtagtatcacctcatacttttcatttgcgacctcatcatccagatgcacagacaattagaacattaactctcatctcaaaaactatacaaactttgggaagctgggggagtctgtccaaaagcaagtcaagtttcaaagagacattcatgtgtgaatttttcaaaatgtttcaagaagaaggatatattatagcagttaaaaagttcttggatgaaatttcatctactgaaactaaagagtccagtggtacgagtgagcctgtgcacctgaaagaaggtgagatgtataaaagagctcaaggaagaactcggattggaaaaaagaattttaagaaacgatggttctgcttaacaagcagagagctcacctaccacaaacagccaggtagcaaagatgcaatctacacaatcccagtaaaaaacattcttgctgtggaaaaactggaagagagctctttcaacaagaaaaatatgttccaagtaatacatacggagaaaccactctatgtccaggcaaataactgtgtagaagctaatgaatggatagacgtactctgcagggtgagccgatgcaatcaaaacaggctcagtttttatcatccctctgtgtatctgaacggaaattggctctgctgtcaggagactggtgaaaacactctcggctgcaagccatgtactgcaggtgtccctgcagacatccaaatagatattgatgaagacagagaaacagaaagaatttattccctttttaccctcagtttacttaagctgcagaagatggaagaggcttgtggaactattgcagtctatcaaggaccacagaaagagcctgatgattattctaactttgtaatcgaggattctgtaacaacctttaagacaattcagcaaataaaaagcataattgagaagctggatgaacctcatgaaaaatataggaagaaaagatccagtagtgcaaaatatgggagcaaggaaaatccaattgttgggaaagcatcttagagtttaacagattggttcagaagaactggaaaatattatttttcttggagcttttcaattcatcatgtattttgttcatggtatttaagaatgagcatccgcttcaatgtcatctgcctccacattgtatttaatatttaataattgaaattaattgtttgggaatcctggtattgatgtattactagagaatttaaagcccaagattcccttcatacctgtgtgaccaaatccatgtttctgcaacttctttttaatcgaaagaatcttcctagaaaagctttgtaacaaagggagaactcctccgtagcaagaaaccatctcttcttgtaacactctgttctgtggacttgttttcactaccatcagtgcctgctctatactgccaacattgtgttttactagaaaattccaattcatgacagttcagagcttttcatttagttcatgtagaccctcccacttt

SEQ ID NO: 25576 - DNA, 4191 bp, Homo sapiens
tgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcactgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacctcttccagctcacgccgcaccacacggacccccagacgtccaggacgctgacattgatctccaagaccgttcagaccctcggcagcctgtccaagtccaaatctgcgagttttaaggagtcctacatggctacattttatgaattcttcaatgagcagaaatatgctgatgcggtgaagaacttcttggatctgatttcgtcctcggggagaagagaccccaagagtgttgagcagcccatcgtgcttaaagaagggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagtggcgccagcaagctgcccatgcaaagccgcagcctttgggagggagaagagaaggaagagcgcagagccggcaaagtgagatgcacgccgtcccggcccatagacaagtggcgctggggtttccctctcccagaaccgctgccaccaccgccacgccctccgcagaaagcccacctggccctgtggaacgtgtcgtcatttgattctgtgctttttgctccttgtttgtggggatctggggatcagctgaaggatcaggaagtgtgggctgtgccctagccacaccacagccagcctcagggagccacggcccgtctagtcgactgtgacatgcacctccggccgtgtgtgcgtcagtctcgtgcacgtctgtcttgcgtgcacggtgcgtgtgacgctgggctctgtggctctgtgcccgggaggcctgctggccccgcctcggctttcggcttcatcacattgggaggttcagagcattactctcccactgtgcctgccatccaggcagccatgggaggcggcctccctgttccactttcgaggttcgtttgattcctggctgaggggtcagttttatggctgggaggtgcagaattacacagaagtcccagtctgaggatgtccttggtgcttgggggatacgggttctgtccacagagtcccttggagggaaaggtgtgggctccagcttctccaggcgtctgcggagcccacagttgaagcccacatcgttttgctgttgaatggggtttaaaatcagaattaacatttgccaccccccgtggaagtttgaagattttaaaaatagaaatgtacatttttcaagctgtttttctttatgtttttgaaggaccatttttaattagctctttgatacaaagtaactcagaacgtcaaaacctatacccactaaagggaaggctgccgggaaggcaaatggaacaggaatggagcctgtctcaggaaggccagctgcaggtcctccagaaaatcaaagaagggaagaaactctgagtttgaggtacaggggcttcggggtgcagacgtccctccagggcccatggtcagtattgcacctgtgttatgaacccccagatgctgtgcagggcaggggcgggggctgctgttttattggggaggggagcatcctaaaaatggggtccaggcagacccctccagacctcacactgccgaggaggcctttcccaaagggcgtcctcccgggatgcagacggcaggtgtgtgggaagcgccgtttaaatacacagcacgacgtatccttgtaccgacttctcccggttcttgtttgaaaatactgtagttcaggctcttgatctagatggcagataggaactttcttgtcacaaaaatactggaggaaaatgttgtaaaaatagacttttggacacacagctgttggggctgcactgagctgcaatttttaacatggatttataacttaatgtttctgtttataaaatactaatgatttgcaatgtattttactggccaattaaaacagatgttttattctttctga

SEQ ID NO: 25577 - DNA, 2931 bp, Homo sapiens
acaaaaccagtgccttggaggtgatggcatcagaagcctgaggcagggaaatgggcttgcattttgtccccccacttttttttttattaaatgcatcatagcaaaagtagattaaaaagaaagagtctcagccccagatgacagtgagcaaggagaaggaggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggaaggtggccatccagaaggaggacttgcagaagtaccacaacagggacacctggttccagctgcagcacgtggacgctgactcggaagtgcagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctgaagcccgccatcgaggagatatgccagagccacaaaccctgtgaaatcgaccctgtgaagttgaaagacggagaaaaccttgaaaacaacatggagaacctacggcagtatgtggaccgcgtcttccacgccatcactgagtctggggtgagctgcccgaccgtcatgtgtgacatcttcttctccctccgggaggcggcggccaagcgcttccaggatgacccggacgtcaggtacactgcagtgagcagcttcatcttcctgaggttctttgcgcccgccattctctcccccaacctcttccagctcacgccgcaccacacggacccccagacgtccaggacgctgacattgatctccaagaccgttcagaccctcggcagcctgtccaagtccaaatctgcgagttttaaggagtcctacatggctacattttatgaattcttcaatgagcagaaatatgctgatgcggtgaagaacttcttggatctgatttcgtcctcggggagaagagaccccaagagtgttgagcagcccatcgtgcttaaagaagggttcatgatcaagagggcccaaggacggaagcgctttgggatgaagaattttaagaagagatggtttcgcttgaccaaccatgaatttacctaccacaaaagcaaaggggaccagcctctctacagcattcccatcgagaacatcctggcagtggagaagctggaggaggagtctttcaaaatgaaaaacatgttccaggtcatccagccagagcgtgcgctgtacatccaggccaacaactgcgtggaggccaaggactggatcgacattctcaccaaagtgagccagtgcaaccagaagcgcctcaccgtctaccacccgtccgcctacctgagcggccactggctgtgctgtagggcgccatccgactcggctccgggctgctcgccctgcactggcggcctcccagccaacatccagctggacattgatggggaccgtgagacggagcgtatctactccctcttcaacttgtacatgagcaagctggagaagatgcaggaggcctgtgggagcaaatctgtgtatgacggcccggagcaggaggagtattcgacgttcgtcattgacgacccccaggagacctacaagacgctaaagcaagtcatcgctggggttggggctttggagcaggagcacgcccagtataagagggacaagttcaagaagacgaaatatggaagccaggagcaccccatcggagacaagagcttccagaactacatccggcagcagtccgagacctccactcattccatttaaagtctgcgggacgcgcccagtggcgccagcaagctgcccatgcaaagccgcagcctttgggagggagaagagaaggaagagcgcagagccggcaaagtgagatgcacgccgtcccggcccatagacaagtggcgctggggtttccctctcccagaaccgctgccaccaccgccacgccctccgcagaaagcccacctggccctgtggaacgtgtcgtcatttgattctgtgctttttgctccttgtttgtggggatctggggatcagctgaaggatcaggaagtgtgggctgtgccctagccacaccacagccagcctca

SEQ ID NO: 25578 - DNA, 1156 bp, Homo sapiens
ggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacctggaccaggaggaggttttcaggaccaaaattgtggaaaagtcactctgcccgttttacggagaagacttttactgtgaaattcctcggagctttcgtcacctgtccttctacattttcgatagagacgttttccggagggattccatcatagggcaaagtgcacctggagctgcggctgagcgaggtcatcacagacactggggtcgtctgccacaagctcgccacacgcatcgtcgagtgccagggcctccccatcgtgaatgggcaatgtgacccctacgccaccgtgacgctggcaggacccttcagatcagaagcaaagaagacgaaagtgaagaggaagaccaacaatccccagttcgatgaagtgttttattttgaggtgacccggccctgtagctacagcaagaagtcccactttgactttgaggaggaagacgtggacaagctcgaaatcagagttgacctctggaatgccagtaacctgaagtttggagatgaattcctgggagaactaaggatcccgttgaaagtcctgcggcagtccagctcctacgaggcgtggtacttcctccagccccgggacaatggtagcaagagcctaaagccagacgacctgggctccctgcggctgaacgtggtatacacggaagaccacgtgttttcttctgactattacagccctctgcgggacctgctgttgaagtctgcggatgtggagcccgtgtcagcgtctgcggcccacatcctgggcgaggtttgccgggagaagcaggaggcggccgtcccgctggtgcggctcttcctacactatggcagggtggtgccattcatcagtgccatcgccagcgcggaggtgaagcggacccaggaccccaacaccatcttccgaggaaactcactggcgtccaagtgcatcgacgagaccatgaagctggcggggatgcattacctgcatgtcaccctg

SEQ ID NO: 25579 - DNA, 5605 bp, Homo sapiens
cagtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactgtccaggctctggggtcttgtgatgagggtctggggagaaagtgggcccggggggaccccggaggctgtcggtggatgtgccgatgatggggctgacagtatgggctctgggcatccctgttcccccctctttcttccccccactcttctggggtcgggggttcctttcccttcccagttgctgtccctgggtcccctctttcatgtcccacaggccacagagcccagtgtgtccaaccagctgttctctcctcaaagcagcccccaagcaagtcccttctctagggtgtccctgaggacagcacagaggcgggactcagagaccccattcctcttcacgcagcccttaccccaagccctctagctgtgtggctggcagtgttggccacgtaggggctcccatccccccaccattgtgtcacatgggctgccaggctcagctcccagctgcgtccacagtgacctggatcagggtggggacaaggactggaccctccttctccagaaggccttcagctcttgccttgccatgcagtcacctccttccccctctgaccccagatcccaaaggtgcaccgttgccccagcccctttctggccccatggggtttctctgatgccttcatcatagaggcccggggctggtccgatggttggcaaaacttgactccggcccagtccccactcttggggacttagaacccctgctgtcctgggatctggcctgcctttctttggtcagtccctgtggtcccccaccagctccccctcccatagggctgcccaccaagccctgcccccagcccaagaggagcccccactgcctgcggggcagtgatgtctggccaccggctcacaccaatgacttggtcctggggtggcagaagcagcaggtgacaggagcagggcccctgtccctctcttctggccctgtggtacccaggccacacgttgtgcccgctcttggggctgaccggctgtagggaccaccagccgctgctactgtgggccgccccggggcagggtgggcagggcttttgtgggttatgaggacacagaagtccctgaggcccccagacctggctcagccaacctccttcctcccccggttgccccccactctaaagcctcctccctcccagcgtccactggctccaggctcctcacaacagcagctcatagacacggggcgtctccaggtggtcccagccctccagatgtttctagctctccaggtgggcgctgttttcacgtctgcctgcatccattcattccttcattcctcacctttatcctgttatctctatttttttaagctaccaggaaggaaagggaagaagagatcacgaaactgggacccccagaaaggaggagtgggctttgaacttagacatctacctcagagctcaaataggttgtttaaaatcacattcaattttcagatgaaggggaactttatagttttttttttttttttttttttgagacagagtctcactgtgttgcccaggctggagtgcaaatggcttgatcttggttcactgcaacctctgcctcccaggttcaagcaattctcttgcctcagcctcccgagtagctgggactaaaggcgtgtgccaccatgcccagctaattcttgtatttttagtagagacggagtttctccatgttggccagactggtctcgaactcctgacctcaggtgatctgaccgccttggcctccgaaagtgctgagattacagttgcgagccactgtgcgtggccagaactttataataagagacttgaagctgggtgtgacggtgcacacctctagtcccagctactcgggaggccaagacagaaggatcaccttgaggccaggagtttaaggccagcctgggcaacatagcaaaacctagtccctaaaattaaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtataaaaaagagaagatatttaggtgacttacagcaaccaattgcaacaaaacaaaatgttaagaaatgatctttttatgaggcaattggaaatttgaacactgatcaactataggatgattggaattattaatttttaaaggtgtgataagatactgcacttggctgggcacagtggcacatgcctgtaatcccagctacttggcaggctgaggtgggagaatcgcttgagctcaggagttcgagaccagcctgggcaacgtggcgaaatccccgtctttacaaaaacaaacaaacaaacaaaaaagatattgcagttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtata

SEQ ID NO: 25580 - DNA, 2787 bp, Homo sapiens
agtccagcgcccgccgcccgccaccccggaccccggtgtctggcttcccccgagccgggaccccgcgatggccaagcgcagctcgctgtacatccgcatcgtggaggggaagaaccttcccgccaaggacatcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctctccagggaccctcctctcctgcccaggacagacccagccagaaccactgctaggatgggccgcacccaggggtctggcctccagggacctagagaatgggagggagaacggggccccaggagacccggccgccaccccacccgctacccttgggtgccacagggctgtgctgttgccaacagtaaacctgctcttactg

SEQ ID NO: 25581 - DNA, 3569 bp, Homo sapiens
tgtttgagaggagggggtagctgggaggggcagcaggagatgccaggaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgccccagctcttctccttcaagcccagctcaggtgccgcctcttccaggaagccccctgggaccatctccagtctcagtgggagcagtgtgtccttggttgctcccagagtctatagcagagatctggacccaagactctggactcccggctttgggctggcagcactggcagcagcgacccctactgcatcgtgaaggtggacaatgagcccatcatcaggacagccacagtgtggaagaccctgtgccccttctggggtgaggagtaccaagtgcacctgccgcccaccttccacgctgtggctttctatgtcatggatgaggatgccctcagccgggacgacgttatcggaaaggtctgccttacaagggacaccatagcctctcaccctaagggtttcagcgggtgggcccacctgacggaggtcgaccccgatgaggaggtgcagggcgagatccacctgcggctggaagtgtggccaggggcccgggcctgccggctacgctgctctgtgctggaggccagggatctggccccaaaggaccgcaatggcacatctgaccccttcgtccgagtgcgctacaagggccggacacgggagacctcgatcgtgaagaagtcatgctacccacgctggaatgagacgtttgaatttgagctgcaggagggggccatggaggcgctgtgcgtggaggcctgggactgggaccttgtcagccgaaacgacttcctgggcaaagtggtgattgatgtccagagactgcgggtggtgcagcaggaggagggctggttccggctgcagcccgaccagtccaagagccggcggcatgacgagggcaacctgggctccttgcagctggaggtgcggctgcgggacgagacggtgctgccctccagctactaccagccactggtgcacctgctgtgccacgaggtcaagctgggcatgcagggcccagggcagctgatcccactcatcgaggagacaaccagcaccgagtgtcgccaggacgtggccacgaacctgctcaagctcttcctggggcaggggctggccaaggacttcctggacctgctcttccagctggagctgagtcgcaccagtgagaccaacaccctgttccggagcaactctctggcctcaaagtccatggagtcttttctgaaggtggccgggatgcagtacctgcacggcgtcctgggccccatcatcaacaaggtgtttgaggagaagaagtacgtggagctggaccccagcaaagtggaagttaaggatgtagggtgctccgggctgcaccgcccgcagaccgaggccgaggtgctggagcagagcgcgcagacgctgcgcgcccacctgggggccctgctgagcgcgctcagccgctcggttcgcgcgtgccccgccgtggtgcgcgccaccttccgccagctcttccggcgcgtgcgcgagcgcttccccggcgcccagcacgagaatgtaccgttcatcgccgtcaccagcttcctgtgcctgcgcttcttctctcccgccatcatgtcgcccaagctcttccacctgcgggagcgccacgcggacgcccgcaccagccgcaccctgctcctgttggccaaggcagtccagaacgtgggcaacatggacacgccggcttccagggccaaggaggcttggatggagccgctgcagcccaccgtgcgccagggcgtggcgcagctgaaggacttcatcaccaagctcgtggacatcgaggagaaggacgagctggacctgcagcggacgctgagtttgcaggcgccacctgtgaaggaggggccactcttcatccacaggaccaagggcaagggccccctcatgtcctcctccttcaagaagctctacttctccctcactaccgaggccctcagcttcgcgaagacgcccagctccaagaaaagcgccctcatcaagttagccaacatccgggcagcggaaaaggttgaggaaaagagctttggcggctcgcacgtcatgcaggtcatctacacggacgacgccggcaggccccagactgcctacctgcagtgcaagtgtgtgaatgagcttaaccagtggctgtctgcgctgcggaaggtgagcatcaacaacaccggactgctgggctcctaccaccctggcgtcttccgtggggacaagtggagctgctgccaccaaaaagagaagacaggtcagggctgcgataagacccggtcacgggtgaccctgcaggagtggaatgaccctcttgaccatgaccttgaggcccagctcatctaccggcacctgctgggcgtggaggccatgctgtgggagaggcaccgggagctgagcgggggcgcagaggcaggcacggtgcccacgagccctggcaaagtccccgaggactcattggcccggctgctccgggtgctgcaggacctccgcgaggcccatagctccagcccggccggctccccaccctcagagcccaactgcctcctggagctgcagacgtgaggcccgccctacgctccccttgctgagtcccctgccaagcgctcggagcccccccaggacactctgcaccccctcaccccggtcctcctcattagggtgcagggcctaggtctcttccaggtgggggaggggggagagtcaggaataaggggatccccagaagtgcagagctgagcaggcttgggcctgtcatggctggccggaagtgtccccagctccctacagacgctgtagccatcactgcctct

SEQ ID NO: 25582 - DNA, 3382 bp, Homo sapiens
gtgtttaactggaaactagaacgagatggaaggggatgttcaaggcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtgccctcaggaagaaccaaggctgggtgggggtccagtgtgccaaactcagacccttggagcctgggagaccttgggccaggctgtttatctctctctgggtctcagattaccctgtataaaaagaggagggaaagtcta

SEQ ID NO: 25583 - DNA, 3040 bp, Homo sapiens
ttgtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctg

SEQ ID NO: 25584 - DNA, 3817 bp, Homo sapiens
ctagaacgagatggaaggggatgttcaaggcccctcccttgactctgaacggacccccagggaacatgcgaccctctctctggcgacgcctcccacccaccactaatacttgctcctggaccggggggcgcggaggttggagagaggagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccagcaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtgccctcaggaagaaccaaggctgggtgggggtccagtgtgccaaactcagacccttggagcctgggagaccttgggccaggctgtttatctctctctgggtctcagattaccctgtataaaaagaggagggaaagtctagatgtgtggttttcaaactggattccaatgaggtagttcaagaacaagggaggagtttctctgactgtgggccaaagaccacccgctagaatgtctgctagaaatgcagatttctgaggcccagccagctactgactcagaatctgagggtatatgaaggcaagaatcagggttatttaacagattccgtaggtcatttggatgagtatcagctttgaggaccacaggcctggggaatgggcaattttattttattttgtttttagagttgggggtctcactctgttgcccaggctgcagtacagtggcatgatcataggtcagtgcaccctcaaacttctggacttcagtgatcctcccacgttagcctccagagcagctgcgactacaggtgcaagccatcacgcctggctaatttttaaatttttgtagagatggggggtctcactatgttgccca

SEQ ID NO: 25585 - DNA, 8167 bp, Homo sapiens
agctgggccatggccgcgaggcaggggtgagaccggcggccacccgtgagccctccgcacccgcaccatgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctggagggctgcagctgcgaacgaacgcccgcgccacccagggccggcgccgggcagggaggcgtccgagacgcgctggacaagcagtattactttactgttctttttggccatgaaggtcagaagccactggagctgcgctgtgaggaggagcaggatggtaaagagtggatggaggccattcaccaagccagttatgcagacattttgattgagagggaagtattaatgcagaagtacattcatctagttcagatcgtagagacagaaaaaattgcagctaaccaactccgacatcaacttgaagatcaagacacagaaatcgaaaggcttaaatcagagattattgctcttaataaaaccaaagaacgaatgcgaccttaccaaagcaaccaagaagacgaagatccagacatcaagaagattaaaaaggttcagagcttcatgcgaggatggttgtgcagaaggaaatggaagaccatcgtgcaggattacatttgttctcctcatgctgaaagtatgaggaagagaaaccagattgtgttcaccatggtggaggcagagtcagagtacgttcaccagctctacatcctggtcaatggctttctccggcccctgcgtatggccgccagctccaagaagccccccatcagccacgacgacgtcagcagtatttttcttaacagtgaaacaatcatgtttcttcatgaaatatttcatcaaggactaaaggcaaggatagcaaactggcccactttaattttagctgatctgtttgatattttgctccccatgctgaacatttatcaagaatttgtgcgtaatcaccagtacagcctgcaagttctcgccaattgtaagcaaaacagagattttgacaaactcttaaaacagtatgaagccaatccagcctgtgaggggaggatgctggagacattcttgacctatcccatgtttcagatccccagatatatcatcacactccatgagctccttgctcacacaccccatgagcatgtggaaaggaaaagcctggagtttgccaaatcaaagctagaggaactatccagagtaatgcacgatgaagtcagcgacactgaaaacataaggaaaaaccttgccatcgaaagaatgatcgtggagggctgtgacatcttgctggacaccagccaaacgttcatccgccaaggttctcttattcaagtaccttccgttgagagggggaaacttagtaaagttcgcctgggttcgttgtctttgaaaaaggaaggagagagacaatgcttcttatttacaaaacactttttaatatgtacaagaagttcaggagggaagcttcatctgctcaagacaggtggggttctgtctctaatagactgcacattgattgaggagccagatgcaagcgatgatgactctaaaggttctgggcaagtgtttgggcacctggattttaaaatagtggtggagcctcctgacgctgccgccttcactgttgtcttgttagcaccctcacgccaggagaaagctgcctggatgagtgacatcagtcagtgtgtggacaatatacgatgtaatggtttaatgactatagtgtttgaagagaattccaaagtcactgtgccacatatgattaagtctgatgcccgtcttcataaagacgacactgacatttgcttcagtaaaacactcaactcctgcaaagtgccccagatccgttatgccagcgtggagcgcctcttggaacgactgacagacttgcggtttcttagtattgatttcctcaacacctttctgcacacctatcgtattttcactactgccgctgtggtgctggggaaactctccgacatatacaagaggcctttcacctccatccctgtcaggtcattggaattgttttttgctaccagccagaacaacagaggtgaacatttggtggatggcaaatccccacgtctgtgtcgcaaattctcttccccgccaccactggctgtgtccagaacatcttccccagtgagggccagaaagctgtctttgacttctcccttgaactcaaagataggagcattggacctgacaacttccagcagtcccaccaccaccacccagagtcccgctgcgtctccaccaccacacactggtcagataccactggatctcagcagaggcctctcttctccagagcaaagcccgggaacggtagaagagaatgtcgataacccacgcgtggatctgtgtaacaagctaaaacgaagtattcaaaaagcagtcctagagtctgcaccagcggaccgagcaggagtggaaagctcccctgcagcggacaccacagaactttcaccttgcagatccccctcaactcctcggcacctccgctatcgacagcctggaggacagacggcggacaatgcccactgctctgtttcaccggcttctgcttttgcaatagccacagctgcagcaggacatgggagtccaccaggctttaacaacaccgagagaacatgtgataaagagtttattatacggagaacggctaccaatcgagttctgaacgtcctccgtcactgggtctcaaagcacgcacaggatttcgaactcaacaatgaactaaagatgaatgtcctaaatttgctagaagaagttttgcgagacccagaccttcttccccaagaaaggaaagccgccgcgaatatcctcagggccctttcacaagatgaccaagatgacatccacctaaaattagaggatataattcaaatgactgactgcatgaaggccgaatgctttgagtccttgtcggccatggagctggcagaacagatcaccctcctggaccatgtcattttcagaagcattccctacgaggagtttcttgggcaggggtggatgaagctggataaaaacgaaagaactccttacattatgaaaaccagccaacacttcaatgacatgagtaacctggtggcctcccagataatgaactatgctgatgtcagctcccgtgccaacgccatcgagaaatgggtggcagtggcggacatctgccgatgcctgcacaactacaacggcgtgctggagatcacctcggccttaaacagaagtgccatctacaggctgaagaaaacctgggccaaggtctctaagcagacaaaagctctaatggacaaacttcaaaagactgtttcctctgaaggaagatttaaaaatcttagagaaacccttaaaaattgtaaccctcctgcagttccttatcttgggatgtacttgacagacctggcatttattgaagaaggaacaccaaactttactgaggaaggccttgtcaatttctccaaaatgagaatgatatcacacatcatcagagagatacgccagttccagcagacttcctacagaatagatcatcagccaaaggtcgcacagtacttgcttgacaaagaccttatcatagatgaagatacgctatatgagctgtcactaaaaattgaacctcgactccctgcttgaagatctggccttgcccctgagtccacgggatgttcatggaaagcaggacagacagaattgtgtatgccttgcctatcacggtacagcacgaagccaggctcctttctccaccaaagaagatggaaccagactggaattctgtctccagagagaaacccagctgtttgggtcaaagacagatgcttcagacttgggtgggaaggtgaaagatggctatttagaaagctggtggcacgttttacataagggaatgtcagatgggagatgctagttgccattttaacaaagcaggtaaatcggtaaattttaaactctgtccatgttctgttagaactcagggacaaggatccatgaaaaagacctgtgatgtttctctggcgctttactggcctgggcacacctaccaatcttctaggatttgactggttccattacatttccttttggtataagcttcacagaaaagctgacacttcctctacagagatggaccaaaacataagcaatttcagtctacagcatgtgcatggttgtcagtgcattctaaatatttctatgtgaggaatggtaccttctgaaactgcctttccagtctttaggcaatgggataggaaagaaagaatgaaacacaaatggatttgtatgtaacatttccttaattaaatgcagtaggctgtgccccagaggattccagacagtggctggctgaggtgggtggggagcttttccttgagactgttggtcctaagaagccagcccttttggagaggcagctgcaaaaaggtgcacgcccatctcaccgacaaaactgtggaacagaaggccaccaagtgctgtggggaatcatgggtttcagtgctgagtgaaaatctatacctaaaaatcatctctgcaccttgctttgtttgttttctttccccactcatagtactgcaggaatctattctcatttacacagacctttttttaggcttactatgaacattggctgtattttttttaaacagtttagtgaaattttcttttcaaaacccacacttccatatgctgttcgtagatctctttctttaaaaactgatgttgagagatctctgagaatattataagtgcatgggaaatgggcccaaccaccgaacagctcttacattacaaaaccaaatgcaagggttagtcctgctacctgaggctggggaagtgaccttccttttcccaagattgtcagttgttgaagaaatagggctatctcattgtttacctccctcttctcttctcagggagactgctgctttaaaagaaggaagagaaaaaatatagttctatttccctgaacctgttgcacctgacattttctcttagcagcatgaaacttattgatgctgacaatgaaaaatggatctgtctggctgctttccctctttccttgcactttaattatgttgctagagctaacagactaataaattccacctgctggctcttaagactcagtgaaagagctagcattggtaatgcaccatagaggtagagaatgtacactttctgcacggtaagtgccatctctgtatgtaactatatagtgaaatatcaactaagtaaaagaaaatataatatttgaagaccattcccaaaatattttcaatagttcatattagccaacagtgtagcactcaacccaaggagggttccttatggatgctttctttttcttttttaaagttgcttgtttgttctctttagtttcaaataagaggttgacgcatcttgatgcatgatgagaagcatgggctgtttggatcctaacaacgcataacttgtgatttatttctcagtgctccagaaactgagggtttgaaataatatgtatcagttgcaccaaacacctcaaggtcttgcagaagaaaagtaaaggttagctttcatggctcaaaagcatagtcctgaagggtgaactaaaaccgggacaaatctgtgagaggaccacacacatactagtttcgggccaaacaacacgtggaaaggtgcatgcattctactctgccttggagttgccagagtccttcagagggaaagggatggttctgtgtgcactttttctggaagttcggactcatttctttgacccaaatgttccagagacactgcagccattcttattaacaaaaaataagacaggagtttccaaatgctccttcccttttggatcgcagcttttcttcaactagtgacaaagcttttgcgcctatttcctgcaggatgttggaactgccccgcactggtcatattaggcactgtcaattgctatgctgacttttagggggtttttgtttgtttgaaaaacagggtctcaccatgttgcccaggctggtctcgaactcctggactcaagcaatcttcctgcctcagcctctcaagcagctgggactgcaggggtgtgccactcactagcctttcgcatttttgtttgagaattacaccactttctggagtctgcagccttcctggagctgcaagagggcaagagagagagctccacctctgagggagtgtctgttgatgacctgcactattcgtgtgccagctgggagaggaatgcacattttaaaatcccttcaatttggtcaaattaaaaatccccaagagcaatttgcagtgttttttctggtcgttaaagtacccatcctcttctgcctacacacaaagcatgcattcccagctgcatctgcctctagtccattatggagacccatttctaagaggagatgggaggtcaacctctaacagccaagtagcgaacatgtatactgtaaaattaacctagaaaatcagaagaaaaatccaatttcatgctttcgaatgaatgcccacattttgtactgtcaacgaaattatcttggagcttttaggggatgccttttcgttattaactgagacatctagttttgctacagggacaaatctcttacctaatccaatatattatttgacagattcaggcatgaagtaaaacgtcgtcacttttccttagtgcttttctgaaggaatttaaagacggaattttaaacggccattgcaatattttcaagtggctctcataccaagtcccattactgtttgttaaatttcagtacgtcttaaagtactacttataaacaaatgaaactcagagaaactgaatcacctggaagagaaaaatccattatggtcccatgtggagtgaataatgatggatcagcaccctttctctcatgttattgtataagacgagacttttgggccagcagcgattgggcagcttttaaattcttaactgaaaagagtaatgcaatacagggattattcccaataaaattaacttttatttaaaagcaagagattttacttagcttttttttttcaaagtttgattttatccccttgaaaaaaaatctcttcactttaaagtataaaggtttttaaaaatccaattgcaaaatgtattatttttacaactatcgaaaaggcataaaagagaacatactatttatggctgaagggtatagccaggctaatgtgcacagagggaatcaataaataaaactctttttcatttcagtaagaaatcagattgtaagtttaatggctccattatagataccaccgtgtaatagaagacttaagtcaatgaaatctaatcagtgtgtcatttctcagcggccattggtgacttaaaattaagatgaggcagagccaaaatggaaaacagtcattttgttgtaggtataaacacatgaacgattcagaaaattattcatctcagctgccatgcagcatgacattaacattaggattgatagcactagtctgatctgctcaaggaaaataatagttctattatacttaatgatgttggtttttacacagctcatttcatttttcactagaaagccagttatgaaagagagctggcctaggcatcccggccctgagtcctaggcccagtctccaactggaaaaccttaggctggtgtttacacatccctgagcctcagtttcctcatctgcaaaacggtgtgaatagtaatccctgtgctgcttatctcacagggctattgtgaggaccaaatggattagactgtaaactgcaaagtgctgtccgcacatgaggtcatctgattactgtcctcagatctcttttgtagaggatttcaatgtatttctttatcatttgagtgtgtgtgtgatggacgaatatgtgtgtgagtttgagaagcatatcgttcgtgtccagttactttgcaaatttgtggacatttgtgattggacagaggggtttgtgctgtggcctaacacttgccaagtgaggtgtaggttatgcctatatgcaaattaaacttcacctttcttgaa

SEQ ID NO: 25586 - DNA, 5789 bp, Homo sapiens
atgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtcagaaacccttcccttgtcaaaaatgcgatgccttcttttctaccaaatctaactgtgaacgccaccagttgcgcaaacacggagttaccacctgttccctgagaagaaacgggcttatcccccagtcaaaagagagtgatgttggatcccatgatagcacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaagggg

SEQ ID NO: 25587 - DNA, 7440 bp, Homo sapiens
atgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttgggg

SEQ ID NO: 25588 - DNA, 5826 bp, Homo sapiens
cgggatggcaactgcggtcaccctgctaaagtcggggcgggggcggcggtcctccccctcaccccccccagtccgagcgccgccgccgccgccgccgccgccgccgcggccgctcagtaacacgtccccaggagactcgcaggagcaacacgtgatgtgtctacttatcagggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatg

SEQ ID NO: 25589 - DNA, 8778 bp, Homo sapiens
gaagctgggcggggggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactggtcagaaacccttcccttgtcaaaaatgcgatgccttcttttctaccaaatctaactgtgaacgccaccagttgcgcaaacacggagttaccacctgttccctgagaagaaacgggcttatcccccagtcaaaagagagtgatgttggatcccatgatagcacagacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttttttttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagctgca

SEQ ID NO: 25590 - DNA, 243 bp, Homo sapiens
gcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagagttttatagcagaggcttcttagaagcttaaacccctgtcccaatgacgtcaagt

SEQ ID NO: 25591 - DNA, 1021 bp, Homo sapiens
gggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgtaagttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaac

SEQ ID NO: 25592 - DNA, 2833 bp, Homo sapiens
ttcagacacctgagagcatcctgttctgggtacagtgtgtgtatgtatatgtttgtttgaagccgctggtcctcgccttttactccttagctggacagcgggttcgggatctgccccatgactaaggctgaagtggaaagttgcgaagatagaacaagagttgttccttagggtggtgtccctaaacttgaaagtggacttggtcctgctcgcaggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgc

SEQ ID NO: 25593 - DNA, 998 bp, Homo sapiens
gcgggcgaggaagctgggcggggggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggaggtaatcagcagtgtggcgggagggttcttctttccctcctaggttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccacca

SEQ ID NO: 25594 - DNA, 9816 bp, Homo sapiens
tagttgtatatttcttaatttcttcaactgtcttatttttccccctctgtttctgatagcactaattgctgccttgcttttctcttgttaaactggcagtctgtaggtgtctgctgtgaacatgccattaggatgcacgaagctcccccccggagccagtggtccgagccattctcacatggtgctgcccttgacgttattggaatgtgcctgggggataggggttgctccgactgtgtgttccaggagtggtggctctgaggtgtgaccctgcccacgtttgggcccagccaggttcagccccccaataaggagggcagcttgataacacaaagaaaacagtgtcaacgagtactaccaagagaagaagacaagaggtcaacacagactcattttctactccgtgtgaatgatagctacagcaggggaaagtttcatagtctatcagtgggtcagaaaatggagttttatagcagaggcttcttagaagcttaaacccctgtcccaatgacgtcaagttcgcccgctggcttggaaggttcagacctatcttccatcaacaccatgatgtcggcggtcatgagtgtagggaaggtcacagagaatggcgggagcccccaggggatcaagtccccctcgaagcctccaggaccaaatcggattggcagaaggaaccaggtaagtgttcacacctagtggtgacctctggtgggttcaatccatgagaacattgggagatgtttccgagtttcctatgataaaaccttggaagaattgggaataaaacggacatacccagaggccttgatcatttttcaagggcaaaatttttatggcttatgttagtttcctttcatggagaaggttttctttgctgtggtgtcgatgttggtggaagtgcccttatttttggccccaccattggattttaactcaagctttcttcacttgatggccatggcagggaacatcactgatttctgtgatgtggtttgtttcctcattcacacagctggctatttttaagtatcttcagattaggtagcaaataagtattgcctgtgctagggctgccgttcagctttctatccttgaaaaagcacagaatttggcttcagataattccagttaagatgctgtttagtcatcttggattttcattgggcatcagatcagaacagggtaaagtaaataggtggaattgagaagggttaatgctgttacaaaagttgatgtcttctctgttgggaaataaatgaatcttcaatgtaagatgggacatttccttgaaaagttgttgctgtcttggcaacatactgttgaacagaaagaaggaaggtggtggaaggaggcagagagtgaatacttctcatttcaactctggatccatgtaatacgagttgacttcctcgtgtttaaagtttggtttaactaatttaatgagactatactaaatccttggagagaaggtggtcttgcatttgtccaggaaccagcaatggatgagaaagcaaacctgctgggcttttgtaaactaattttctttttttataaataatcctactgtggctgtccttatacagaattctctgagtattaatatgatggttttctataaattcttagaagtagagccttaattaaggctttcgatacaacttgccctacaagaaaagttgtaccagccccaaaccctgccagcagtatgggggaggatgcatttctccacaccttgctgaaggatggggacttggcagagttcagtgatgttttagggttggaacattgattcctttctctctctcttttttcccttttctccttgtgcctctcttcctgtgggtgcctgagaaaatactcagcctgtatgactgtggcctgagtcgagaaggagtgctagctctgagaagaaaaggaaacgaaagaggagaagtcttcctataactgccccctgtgtgagaagatttgcactacccagcaccagctgaccatgcacattcgccagcacaacacagacactggaggagccgaccactcatgcagcatctgcggaaagtcactgagctcggccagctccctcgatcgccacatgctggtgcactctggcgagaggccttacaagtgcactgtgtgtggccagtcatttaccaccaatgggaacatgcacagacatatgaagatccatgagaaggaccctaacagtgccacagccacagcccctccatctcctctgaaacgtaggcgattgtcctccaagaggaaactgagtcacgatgccgagtcagagagagaagacccagcaccagctaaaaagatggtagaagacgggcagtcaggtgacttggagaagaaagctgatgaagtctttcactgcccagtatgtttcaaggagtttgtttgcaagtatggactggagacccacatggagacccattcagataacccactaagatgtgacatttgttgtgtcacctttcgaacacatcgaggactgctgcgtcacaacgcgcttgtccacaaacaacttcccagggatgcaatgggcagacctttcatacagaacaacccttcaattcctgctggcttccacgacttaggattcacggacttctcctgtaggaagtttcctcgcatttctcaggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaagtgaagcaggaaaacatctcctttctgagcccttcttccctggtcccctatgactgctccatggagcccatcgacctgtccatccccaagaacttcaggaaaggggacaaggatttggccactcccagcgaagccaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgggcacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatgctcacacacactgacagtcagtcggatgcggagactgcagccgccgcgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcgcggaagaggacgcgtcgagcaaccagagcctggacctggacttcgccaccaagctcatggacttcaagctggcggagggcgacggcgaggcaggcgccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccagcactgcagaggaggggccccagcccgcccctgaacaggaggagaagccccccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacctgagctcctggtccctcagccaagacctcaggggtccccagccagcctgctgctggggacccctgtgcttgctgcagtgtatggagcctcttgccttcccctggggaggcacccctgtaccccagcttccttcccctggccttttctggccccagtgctcctcctttacatagacttgttcacacagaaacgtgcacgcccccttttctccgccacttcaccagtttctgaaatccaacctcccagacttcacaggaagatagatattcttgagataatgaaaagtgatatcttcgcatacgaaaggaaaaaaggttgaggtatatatgatttttaactgtattaggggtgtatgaaccagtttaaaaacgaggttttatttactgtagagatgaatgcaaatcagaaccaatgatcccttggcctacttagttaaaaccagttcatacatcccttagggtttttattattattattattattattacagttgttattgttgtttttgttgttattattatttggggtttcttgtgttttttctttgcgactctccacactaaacttgcaatattgtggggagaagctgtgactaaactctacgctgcggtgagatgtagcagtaatcagctcccagcgacgtgtgtagctggggctgccgctcgcaataatcactattgatttaaagctttacttagccttgatctgtaccctcgtagtcaataaggtcttgccacattttattagtgaggtggagaaacgtattatttgtttgttgtttttgcccttcccccaccccccaatattaaactgtgaaatttgtgatttgtttaaactctgggtgaatcatagcttagtttgcatgtccagctaatttgtttctatacattttgtttgattctctttctccttctctcagggcttttacaaaaaaatatatatatatggatcttctgaaaagttttttgaggtgcaagttttttctcttttttttttttttttttttttctcattgattaatggacatgatgctgagattcaatcactacatgaaacacctggctgtgaaaacaaaacaacccagagggctgtgttccaagcagcgctggggaagctacgtaacagtcggatgccagttttggaagattcaccatgcgttctgaccctctgttcgtctctttcctctcctctttcttcaagaaggaaattgatcctagtgatttcagcccatgcattaaacaggaaacaataataaatttgtagaattcatatttttctaaagggaacttaaaaactgctgctacatgttatgtacaaaactggtttatgccacatgaacagagaatcacaagtttggttttggtactttttgttcctctttgtattcagttgtatagaacttccaaattcagaatgagaagaaagctgttctgtatcaaaccatttaagcaataaatgttatattttaaaagc

SEQ ID NO: 25595 - DNA, 3834 bp, Homo sapiens
gcctggccctggagacacgtctggagagctgttctcctaatatgggtagggtcgggcgtggagctggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaaa

SEQ ID NO: 25596 - DNA, 955 bp, Homo sapiens
ggcagcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaa

SEQ ID NO: 25597 - DNA, 3919 bp, Homo sapiens
gggcagctggagtgcgttctgccgaagcttgtggttgcacgcccatcgtcttaggggctaccttccgtggtgagtgtgtgcggtgttgcacttggggttgcttctcgctgcgtggccgcagcggggctgaacccttcccactccatcccctccccgcacccggaccagcccctgggacgccctcggacgcccacccgctccaaccctggggaagcctcagagtggcagcgaaggcctcttgcctttccgcctctgcgcttgctgtcatcgcccacgtgctttgttgttgttcggtgcagaccatgtccaagtctctgaagaagttggtggaggagagccgggagaagaaccagcccgaggtggacatgagtgaccggggcatctccaacatgctggatgtcaacggcctctttaccttatcccatatcacacaactggtcctcagccataacaagctaacaatggtgccaccgaacatcgcagaactgaagaatttggaggtgctcaacttttttaataaccaaatcgaggagctgcccacacagatcagtagccttcagaaactcaaacacctgaaccttggcatgaacaggctgaacactttgccacgaggcttcggctccctgccagctcttgaggttctggacttgacgtacaacaacttgagcgaaaattctcttcctggaaacttcttctacctgaccaccctgcgtgcactctatctaagtgacaacgattttgaaatcctgccgccagatattgggaagctcacaaagttgcagatactcagccttagggataacgacctgatctcgctgcctaaggaaatcggggagcttacccagcttaaagagctccacattcaggggaaccgcctcaccgttctgcccccagaactaggaaacttggatttaactggccagaagcaggtattcaaagcagagaacaatccctgggtgacccccattgcagaccagttccagcttggcgtgtcccatgtttttgagtatatccgttctgagacatacaaatacctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaaaatcaaa

SEQ ID NO: 25598 - DNA, 1746 bp, Homo sapiens
agcaagcggcctgtgcccagatcctgggagaaccccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacaggagacgttttcatcctggtgttcagtctggacaaccgcgactccttcgaggaggtgcagcggctcaggcagcagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccaaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtctgaggtctttaaagttattgctttatttggttttttaatatacaataaaataatttaaaatggaaaa

SEQ ID NO: 25599 - DNA, 3412 bp, Homo sapiens
gcgcggggagaaagaagccgtccctccggcgctgggagagctgcagagccgcgggcagagaaggaggccgcggccgagcccggcagcccgataccccccatccgagcgaccccctttggggcaggcggagaaggtggcataggcgaccaggagggttcgcccacctgggacacgcacccacagtcacctccaaaggaccccccctccccaagtctctaggagctgctccttcatcactggagtcgcccctacctctctgcccccagcccgagagccccaggcggggacccccggatcggacgtccccaagcctccgggcacctggctcagcaggaggcccccggctcggggcagggcagggccggcggcggcgagccggagcccgccccctgcccgggccccgccgagccctcggagcccacccatggggcacctgccccttgcgcctccttgcccggccgcgcccagcccggcgtcccgagcagcgcaggggaggatccccgcgcagtgacccgggagccaccacagactctgggaggctcggcggctggagcagcaggcagctccccgcagctcccggcgcttccaggcagctctctgagccgtgccagaggcccggcccgccattcccagccccgagccatgatgaagactttgtccagcgggaactgcacgctcagtgtgcccgccaaaaactcataccgcatggtggtgctgggtgcctctcgggtgggcaagagctccatcgtgtctcgcttcctcaatggccgctttgaggaccagtacacacccaccatcgaggacttccaccgtaaggtatacaacatccgcggcgacatgtaccagctcgacatcctggatacctctggcaaccaccccttccccgccatgcgcaggctgtccatcctcacaggggatgtcttcatcctggtgttcagcctggataaccgggagtccttcgatgaggtcaagcgccttcagaagcagatcctggaggtcaagtcctgcctgaagaacaagaccaaggaggcggcggagctgcccatggtcatctgtggcaacaagaacgaccacggcgagctgtgccgccaggtgcccaccaccgaggccgagctgctggtgtcgggcgacgagaactgcgcctacttcgaggtgtcggccaagaagaacaccaacgtggacgagatgttctacgtgctcttcagcatggccaagctgccacacgagatgagccccgccctgcatcgcaagatctccgtgcagtacggtgacgccttccaccccaggcccttctgcatgcgccgcgtcaaggagatggacgcctatggcatggtctcgcccttcgcccgccgccccagcgtcaacagtgacctcaagtacatcaaggccaaggtccttcgggaaggccaggcccgtgagagggacaagtgcaccatccagtgagcgagggatgctggggcggggcttggccagtgccttcagggaggtggccccagatgcccactgtgcgcatctccccaccgaggccccggcagcagtcttgttcacagaccttaggcaccagactggaggcccccgggcgctggcctccgcacattcgtctgccttctcacagctttcctgagtccgcttgtccacagctccttggtggtttcatctcctctgtgggaggacacatctctgcagcctcaagagttaggcagagactcaagttacaccttcctctcctggggttggaagaaatgttgatgccagaggggtgaggattgctgcgtcatatggagcctcctgggacaagcctcaggatgaaaaggacacagaaggccagatgagaaaggtctcctctctcctggcataacacccagcttggtttgggtggcagctgggagaacttctctcccagccctgcaactcttacgctctggttcagctgcctctgcaccccctcccacccccagcacacacacaagttggcccccagctgcgcctgacattgagccagtggactctgtgtctgaagggggcgtggccacacctcctagaccacgcccaccacttagaccacgcccacctcctgaccgcgttcctcagcctcctctcctaggtccctccgcccgacagttgtgctttgttgtggttgcagctgttttcgtgtcatgtatagtagtagaaatggaaatcattgtactgtaaaagcctagtgactccctccttggccaggccctcacccagttcagatccacggcctccacccgggacgccttcctcctctgctcccaaacagggtttccgtggcctgtttgcagctagacattgacctccgccattgagctccacggtttacagacaattgcacaagcgtggggtgggcaggccaggactgcttttttttaatgctcccatttcacagaggataccaccgagactcggaggggacacgatgagcaccaggccccacctttgtcccctagcaaattcagggtacagctccacctagaaccaggctgccctctactgtgctcgttcctcaagcatttattaagcacctactgggtgctgggttcactgtgtcctaggaaaccaagagggtccccagtcctggcctctgcccgcccctgctgccccaccaccttctgcacacacagcggtggggaggcggggaggagcagctgggacccagaactgagcctgggagggatccgacagaaaagctcagggcgggtcttctccttgtgcccgggattgggctatgctgggtaccaccatgtactcaggcatggtgggttttgaacccataaaccaaaggcccttgtcatcagctcttaacaagtatattttgtattttaatctctctaaacatattgaagttttagggccctaaggaaccttagtgatcttctattgggtctttctgaggttcagagagggtaagtaacttcctccaggtcacacagcaagtctgtgggtggcagaagcaagctagcgctgggcattcagtacataccacgatgtgctccctctcttgatgcttggcccctggggccttcagggctttgggacatcttgtcctcaaccctctccctagatcagtctgtgagggtccctgtagatattgtgtacaccatgcccatgtatatacaagtacacacagatgtacacacagatgtacacatgctccagccccagctctgcatacctgcacctgcaccccagccttggcccctgcctgcgtctgtgctcaaagcagcagctccaaccctgcctctgtccccttccccacccactgcctgagccttctgagcagaccaggtaccttggctgcaccggtgtgtggcccgctctcacccaggcacagccccgccaccatggatctccgtgtacactatcaataaaagtgggtttgttacaaagc

SEQ ID NO: 25600 - DNA, 2264 bp, Homo sapiens
gcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcattctgtca

SEQ ID NO: 25601 - DNA, 655 bp, Homo sapiens
ttttagtagagacggggtttcactgtgttagccaggatggtctcgatctcctgacctcgtgatccgcccgcctcggcctcccaaagtgctgggattacaggcgtcagccaccgcgcccggcctataatttttttttttaactccttcactgttgttggcagaatttagtttcttcctgttacaaggattgaggtcgccatttccttgctggtagtcacctgaggactgttcccagattctagagactgcctgcataccttggcttatcaccttccactgcctgcataccttggcttatgccctttctcctgcatcttccaagccagcaatggaagaggtaaccatccatcacggttttcccagaacaggctgatttgcgtcttctgtcctggcataaggatcccttcactctcggaagtgttccggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccct

SEQ ID NO: 25602 - DNA, 2134 bp, Homo sapiens
attggagttgactaatatgaatgtatgttattcaacccaaagagacatgaagaggcccaaaagtgactctctccattgccccactgcatgtgtttgtacactgaatgcttacagatagatggtaaatgattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtga

SEQ ID NO: 25603 - DNA, 2060 bp, Homo sapiens
gaattcccaaatttcttttgtttaaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctaggttttctttaaaattttattttgttcttcagttcaagcatcttctcactaatgtttttcactataacagagaattcatttcaatttgagttggttctctcaatgatctattgatcattacaccctaactctccttccttggctcaaacaatattttccctataacaaaggcaataggacacaaaattcacatcctgctgggccttttttcatcaagtcagggtgatataaaaacattggaagtcttttcaccaaaccctgactttattgaatgctagtagaagatgtagaattagagacatctgatttgtttatcaccttagcagaaaaaccacagtccaaaagacaagcaaattaagaatggagcttaaccatgcctccattgggaagtctagactttgagccaggtacagtaagaaaaattagcctctgattcattaagtttgccacatgacttattttgatattttggatacattaactcacttaggagaattcagaaaagaatgggtgattaaagttcattacagctgaataaatgtgtctaaaacagactcttgtattctgaaagtacagtctacaactgataaaaccttatgattcttttctcccccattatgcccctatatatatcaagatttgggtactttattttagtagaaaatatatatcttttacatatgtatgtatttataaatgcatagatatatgtataaaaatttgtaagcgttagcggcattaattcaccaatgcatttggacaacttgatgtaactgactttattttatgtgactataataaaaagcataattttctcat

SEQ ID NO: 25604 - DNA, 1383 bp, Homo sapiens
gcagtccctccgccgctagtcggagcgagcgcgagtgaggagacccccgccgggccactggcacttgcttctgcggcgagtcccacccacgaccgcagcccagcaactcgcaaacgcaacctgaagcctgggctgcgcagtgtgggagggcttcgcgatcttgggggacccattccgaacttgcagaggaccgtagctctcctggcctggagagtgtgaacaggattgtggactcttccaagattcacaatgatatggtgaatccaaagactggaaccaaaaagatttactcagtgctttagttttaacaacagtaaattgtctaccaacacccatcatggctaaaagtgcggaggtcaaactggcaatatttgggagagcaggcgtgggcaagtcagaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttaggcagcccagctgaggtggaccaactaattggaaacactcttccccttctgttcccctttcaaaaataaaacaaaatattgcattctttgtttggattctgagaaatgtctgggcttcccattgtttctggcctctaataggttgggaagttttagcgtgttttatgcaatttcagtgctaacaatttcttcctttcctgcttgaataagatacactctaatggcatttgaacatgtaatcaccagagattctgaaatgactggtttatgttaagctatttttaggcatcttcaccttgctttaagtaggttgaagtttttgcaaaggcatttaaaaattcaatttcttgtcagatactacaaataattttcttaaaagtctaagatagcagaaaatacagtaaaaacacaggagaagaagctgagctattggaacaggaaatagaaggaactctagtttctgtttgaagtgaggattttctgaattatctaatatcatctagg

SEQ ID NO: 25605 - DNA, 3194 bp, Homo sapiens
gcgctccggagggagagctggggctggaggttcctaccccctcggcggcccgcatctgcccccgcgcgcccgccctgagcccgccccgactgggcaggcgggggagcccctacttctctccccccgggcgggggagccggggggcagcgccggagcccggggggagctcagccccgccgaccggccggccagggcagggggcagctaggacggccccggtccaggtggaggccgcagagggcccagggcaagcagaggcagcaatggttggtcctgacggtggctgagcccccagcccctggaatatgcagcccgggggagccccagacagcggcaaggacgaggtggcggagtggggcgggaggcatggtctccacctaccgggtggccgtgctgggggcgcgaggtgtgggcaagagtgccatcgtgcgccagttcttgtacaacgagttcagcgaggtctgcgtccccaccaccgcccgccgcctttacctgcctgctgtcgtcatgaacggccacgtgcacgacctccagatcctcgactttccacccatcagcgccttccctgtcaatacgctccaggagtgggcagacacctgctgcaggggactccggagtgtccacgcctacatcctggtctacgacatctgctgctttgacagctttgagtacgtcaagaccatccgccagcagatcctggagacgagggtgatcggaacctcagagacgcccatcatcatcgtgggcaacaagcgggacctgcagcgcggacgcgtgatcccgcgctggaacgtgtcgcacctggtacgcaagacctggaagtgcggctacgtggaatgctcggccaagtacaactggcacatcctgctgctcttcagcgagctgctcaagagcgtcggctgcgcccgttgcaagcacgtgcacgctgccctgcgcttccagggcgcgctgcgccgcaaccgctgcgccatcatgtgacgcctgcgcgcccctcgggctgcaccggcactggccgagcggagggcggggccgtactgcggggctggggcggggagcgggcgggaaatggaactgtgacggtcccggcctgaggcccctgcagccacgcacctcccggtgagaagcagagcgcgagagggagccctccgtaactgcccagccctgccccttgcccccgtggcttcctgggacagccgccttcagtgctgtatttagtgcagtgcccggcccgacccgcgggggtgccacagccttttgggatgggggtgagcgtgcaatggaggctgggggtggcgaggtgccgccttggccgggcccccacgtgtcttctccagaatgtgtctgtctttgcctggtgtcttcctttcccgtgtccgcccaccccagcgtctgttggtacttacctgtctcacctaccctccagtcccctcccagctccgctcacagggctctcatttcgtccatccccttgtcgcagatcctggcagcttctttgtgaggccaggccttctgactgtcagcaccaccggcacagggcagagatgcgggtggcccaaggaccacgatcaaggggtccgggggaccgaggtcccagatcagtgaggggagaaggttgagctctccggcttccagggagacctccccgcccagcagcccccagagacacaacaacctaccttccagccttaactcgatggtccgtccctgccaggtgcccctcactcttcctgaccccaaagccagatcaccccctgggttaaaactttttttcttttttttttttggacagagtgtggaaagggagccccccaaaggatagcttctttttcatgatgccaggctccagtcctttattcccttctgcatactgcaatctgatctgtcagactggggaatgttgggttctggggtctggtcgtgggcaggatggtgcccagaagggggttaggttgtcccagtgaaaattctgttgccccgtctcaaccccatctgactaccccagactctgcctgcctcagatctcagactatcctgattaatctggggaagaacagagccagggaaagaatggtggggacccctgtacttgggggagacacacctgcatcttcctcctgccacagatggaggccctcaggatctgacaccctcttgtcccaacaccagtcagccctataccctaactcactccaccccattttctccggctgcctggccgggtttctacctctcgtcaccggagctgatcactgtcagttttgtaccgatttagaaataacaataataatgaagattctaggaatggcatgagggattgatgggggacttggagggagggacaagtggtgccctgtcccctgctcccctggccaaagaaagctgtccttgaggctgagccctcagccctggcctggtggggggacagcaaggtcccttgttataagaggggcagagaggacaactccgctttggccaacctagccaaggctgcagcatatagaccaggaaatcaggtagcccagactggtgatggagcagagtctgggggaagggtcgtgggtggggaatttatcaccaacatccattgtagggggaatctatgattctgcttccccagcggattcccactctgtccaccaagtggggggtagcacagcctcacagcaaccgccctgaccttgggcagtctagtgttcctgcattctagtccctgctgtgctgcaggactttgggcaagtgacctgccctctgtgagcctccctctgacacagaggaggtggctccccttccccacaccttagagtggctgggagggtaacaaagagggcctgcccctttagtctcctgcacccctgccccctggttcaccagagggagcggatgaaggatggcagcatctcacatgccccatcaccaactctgaggcacctggggtgggggggcggagcccaggcctctggctgctcccctgtgggagccattggaatgtatcccctgacaggcccccttccgcctccacctcaacccaggtcttggatttcaggtccctccacccccattctgagtctctgtccttctccttccacccgctcccagggtttcccaccacagggtctggaagtgtgtgtgacgcccattgagctgttacccgaagtcagattaaaaatcagggagtgttttccctcgtttctgta

SEQ ID NO: 25606 - DNA, 1543 bp, Homo sapiens
gggcctcccaaagtgctgggattacaggcgtaagccaccgcgcccagccccttagcaccttttaaaaataaaaagggcagcgttttacagcaatctgtcccattgttgcagaaacatccaactgattgcactttttcttcttctctcgtcaactcgtaactcctatctcaagttcacccacaggtctagtgactccggctggctgctgcggggcgaggagactcgcagaatgcctgactagaggccactcgcgcgctctggacggtggccgtatctccagggtctgagccccggagccgcagtcctgccgcagagcgcctggagccgcgagcagctagcagcccggcgaagcgcacagcctcggcgatagtcagctccgcggcctctgctcccgcccctcccggccgctccgggaaggggcggagacgaggaggagctgggacggccgccgcgctcccgggcgcaccaagccctttaaaagccgcgggccttgacagttctgcaggcagccgccgcggtcccggacctctagtcccgcactcccagctggcgagccggctccgggtgcggcgaggcccagccctctcggattgcgcgccggaccccgggacgcgctccatgcggccgctcagcatgtccgggcactttctgctcgcacccatccccgagtcctcctcggactacctactgcccaaggacatcaaactggcggtgctgggcgccggccgcgtgggcaagagcgcaatgatcgtgcgcttcctgaccaagagattcattggagactatgaaccgaatacaggcaagctgtattcacggctggtctatgtcgagggggaccagctctccctgcagatccaggatactcccgggggcgtccagatccaagacagcctcccccaggtcgtcgattccctgtccaaatgcgtgcagtgggccgagggttttctgctggtctattccatcacagactatgacagctacttgtccatccgacccctttatcagcacatccggaaggtccaccctgactctaaagcccctgtcatcatcgtgggcaacaagggggaccttttgcatgcccggcaggtgcagacacaggacggtattcagctagccaatgagctgggcagcctgttccttgaaatttccactagcgaaaactacgaagatgtctgtgatgtgtttcagcatctctgcaaagaagtgagcaagatgcacggcctcagtggggaaagaagaagagcctccatcatccctcggccccgctctcccaacatgcaggacctgaagagacgcttcaagcaggctctgtctcccaaagtcaaagccccctctgcactggggtgaactatctcagacagatgcctctcctttttaatacgcatttgtgcagctaaaagactgggcttctcgctttttaatcacacattcagagtttatttttataaaaaaattgattttcaagtacatgtgtatttctgaaaattcaaacagtgattgcctagaagctggataaaattttgttttgttttattaaaagaac

SEQ ID NO: 25607 - DNA, 1993 bp, Homo sapiens
aaaacagccggcgcgccgcgcgagtgcagtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaa

SEQ ID NO: 25608 - DNA, 1569 bp, Homo sapiens
attcccctggtgggggtggacagacacgtcagcccccgcagcagcgtggaccgggggcgggagcgggggcgggtggaggcttaaataggcggctctggagccagagcccagtgcgggctgagaaggcggtggctgcagcagcagcggcggcggaaaccctaaagtccgagtccggactacgagtgcgtggcctcctaatccggatcctagtcctgagcgtgtctgtgtgcgagtggacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 25609 - DNA, 1476 bp, Homo sapiens
cagtgcgggctgagaaggcggtggctgcagcagcagcggcggcggaaaccctaaagtccgagtccggactacgagtgcgtggcctcctaatccggatcctagtcctgagcgtgtctgtgtgcgagtggatcccctagacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcagggcacacctatgatcgctccattgtagtggacggagaagaggcatcactcatggtctacgacatttgggagcaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatgagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgatagtcatg

SEQ ID NO: 25610 - DNA, 1057 bp, Homo sapiens
tgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacggcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacct

SEQ ID NO: 25611 - DNA, 1648 bp, Homo sapiens
cgccggaagtgggtggtggcggggacgcagcggctccctcccggaaagcgagcgtatctcccgagccgttgccactgacagccgcgggcgctcccatctgagtaagagccagcccgtccgcggcctctccagccccgggttcgcgctctcgactctcctgcctgcccagctgcgcggcggagcggagcgaggcgcggcctgcgagtccccggcagcccccgacccctccctcggcgctgcgtgtaggccgcgccctcaggcccagtccgcggtgccccggcgggtgatgccaaatacagccatgaagaaaaaggtgctgctgatggggaagagcgggtcggggaagaccagcatgaggtcgataatcttcgccaattacattgctcgcgacacccggcgcctgggggccaccattgacgtggaacactcccacgtccgattcctagggaacctggtgctgaacctgtgggactgtggcggtcaggacaccttcatggaaaattacttcaccagccagcgagacaatatcttccgtaacgtggaagttttgatttacgtgtttgacgtggagagccgcgaactggaaaaggacatgcattattaccagtcgtgtctggaggccatcctccagaactctcctgacgccaaaatcttctgcctggtgcacaaaatggatctggttcaggaggatcagcgtgacctgatttttaaagagcgagaggaagacctgaggcgtctgtctcgcccgctggagtgtgcttgttttcgaacgtccatctgggatgagacgctctacaaagcctggtccagcatcgtctaccagctgattcccaacgttcagcagctggagatgaacctcaggaattttgcccaaatcattgaggccgatgaagttctgctgttcgaaagagctacattcttggttatttcccactaccagtgcaaagagcagcgcgacgtccaccggtttgagaagatcagcaacatcatcaaacagttcaagctgagctgcagtaaattggccgcttccttccagagcatggaagttaggaattccaacttcgctgctttcatcgacatcttcacctcaaatacgtacgtgatggtggtcatgtcagatccgtcgatcccttctgcggccactctgatcaacattcgcaatgcccggaaacactttgagaagctggagagagtggatggccccaagcacagtctccttatgcgttgaatattgccaaatgctctttctgaaaatgctgaattgccttttttgtttgcatcctttatttttaatattcataatgtcgtgtgcttaaaagtgggctttgaagtgtgtgctgcttactcctttcatctttctccccgcttccccagtctttaaacattggacgctatttactcagctacccagtagagcttgaagctgacctttctgagaagttggtatggtgtaacactaaagtaggtggttcgtgtgtgttctcattacctggttatgatagatatgcacatcaaagcctttaccagtatcttcctgtattccgtatcagattgcaaagacggaatgttactattttatcagcaaggtattaaaatgcatttataaattcttcttggcttcattcatgaataaacgtgttagcaattt

SEQ ID NO: 25612 - DNA, 1573 bp, Homo sapiens
cagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaatactagaccgtatacatagtcttcaaattaatagcagtttgagcacctactctctcgtagactctgttggaaatacaaagacatttgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacatt

SEQ ID NO: 25613 - DNA, 2061 bp, Homo sapiens
ggggtaaggcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggga

SEQ ID NO: 25614 - DNA, 644 bp, Homo sapiens
agatgcccacgtgatcctggcctgcagttgggtggctgcggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaa

SEQ ID NO: 25615 - DNA, 2732 bp, Homo sapiens
ggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttcggctacggcgtggaggaggaggaagaggaggcggcggcggcgggcggaggggttggggcaggggcaggcggtggctgtggtccggggggcgctgacagctccaagccgaggattctgctcatgggactccggcgcagcggcaagtcctccatccagaaggtggtgtttcataagatgtcacccaacgagaccctctttttggaaagtaccaacaagatttataaggatgacatttccaatagctcctttgtgaatttccagatatgggattttcctgggcaaatggacttttttgacccaacctttgactatgagatgatcttcaggggaacaggagcattgatatacgtcattgacgcacaggatgactacatggaggctttaacaagacttcacattactgtttctaaagcctacaaagttaacccagacatgaattttgaggtttttattcacaaagttgatggtctgtctgatgatcacaaaatagaaacacagagggacattcatcaaagggccaatgatgaccttgcagatgctgggctagaaaaactccatcttagcttttatctgactagtatctatgaccattcaatatttgaagcctttagtaaggtggtgcagaaactcattccacaactgccgaccttggaaaacctattaaatatctttatatcaaattcaggtattgaaaaagcttttctctttgatgttgtcagcaaaatctacattgcaacagacagttcccctgtggatatgcaatcttatgaactttgctgtgacatgatcgatgttgtaattgatgtgtcttgtatatatgggttaaaggaagatggaagtggaagtgcttatgacaaagaatctatggcaattatcaagctgaataatacaactgtcctttatttaaaggaggtgactaaatttttggcactggtctgcattctaagggaagaaagctttgaaagaaaaggtttaatagactacaacttccactgtttccgaaaagctattcatgaggtttttgaggtgggtgtgacttctcacaggagctgtggtcaccagactagtgcctccagtctgaaagcgctgacacacaatggcacgccacgaaacgccatctagtctgaatcccagcgtcggggctctgtgccagcttactcttcactccagggtcggatgccacgtgctacaggacatgggagctgctgcttgtgggaatctggtgcctgttccactagagacaaggggtagagtttctcatttggatgaaaaccccttcaactggtggtgtacaactgaagctactatatcttttttgaaaatggcaaaaaaaaaaaaaaaaaattctggagaccacagaactcaagtgtgtgtttctcctcttttgggtcccctttaagtagttgggatattttggacctggagataacaccagttacccatccttaccagggaatgttgccatcaattccagttgaaaataatagaaaagactgaatttttatatgcttcacttaggctttcatttgagtagactctaaaaattctgccttgcttaagttctaacactgcctctcagatttcagttttggacattgcacaactaagaccttttaaatgcatttgcttgctaactcggaagacacatagtctgcagcaagacattcctatattgaagaaatgagagaaaattttatgctgcatcaggtggagagcaaggctcaacggtggttgcattagttccctcggaagtattgaaaaaactttgaaatggaagaaaatttttgcacctatgttctgagtaccagatgtctgggttctttcttctgcattagataaatgatcatgctcagtgtaacaaagggaattaaaagttttcccacagtccccttctaggggagaaactcattgtgtcactgaaatgtttagcttactttaatcttgatatcagcctctacagaccttttattctaagctatcgagcttcttgattgcatttggttgaccacgagtgaccctaaggcattgggggactgtccactgggagttggagtgagcacgtggtgctgcaacaggcattgttttacatactttgtctctagtattctgacaccaagtgtcaactgtggtactttctttgcctaggatatgaattcataattgttgcttttgttgatggttgataccctttccattgatttaaacctaacacattatttctattccacatgcccagtagacatatattccaaagccactggaccacttgagtacataagtgccactgtttaatgcaatatgtatattcaggtctgtaaagctaacagtgtgacttggagtgcttcctgcaggtgattctgacttgagtatttacatggaccatggtgatatccaaaagaaaaatgctttttatatttatagattatttcattgaactatatatgaaatgggtatcaataaatgtatttactccaaaa

SEQ ID NO: 25616 - DNA, 4015 bp, Homo sapiens
aggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctccttctcactggtgataacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaggcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaaggttctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgta

SEQ ID NO: 25617 - DNA, 4900 bp, Homo sapiens
ctctctctctctccctcctccgggaggaactgccgcgctccggctgactcctccgccggcgggcggggcgggggagggggcttcgggcgcgctgggaaccgcgggacccggacctgggcgccgcccgccgggggacgcgcggcccccgcttccgccgggccccgctgagctctagacaaacctccgcttcagaaataggctgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggagttctggacttcagtgaccccttcagcactgaagtgaagccgagaatcctgctcatgggcctgaggagaagcggcaagtcgtctattcagaaagttgtctttcacaaaatgtctcccaacgaaactctgttcttggagagcactaataagatatgccgggaagatgtttccaacagctcctttgtcaattttcagatttgggacttcccaggacagattgacttttttgaccctacatttgactatgagatgatcttccggggaacaggagcactgatatttgtcattgactcacaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggagagaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatctccttctcactggtgataacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaggcatgcttgtggggcattagaaaatgagatttttttttttttaaagcagagcctcctaagaacatcaaagttggtcctagcaaaatatataaagtccctaaagcaacttatacttgaaactttttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaaggttctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgtactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtacagactggatgtaatttgtaatcaggtatagtccatgttttactttaagcagtacatcacttaataaccattgttaagccattgctttcaagaatgttaactgccaatttaaaagcatgtgtcctaggttcatgctttggtaaagctctcatttcaagtgtattcatagctaagctttctgggagcagaattgtctctttggtgaaaaggaagtacagcctttcctgtttctgaggttgcttaccatacatgtatgtcactgtttcattggccctgttacatccatttggtaaaatttatttgtcctgattaaccagctctcattttatggaaatgatgataaatctcactacttaaattta

SEQ ID NO: 25618 - DNA, 382 bp, Homo sapiens
atgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgagg

SEQ ID NO: 25619 - DNA, 2778 bp, Homo sapiens
cctagtcccagcccagggggccgctctcgccggcgtcgagggcgtggcggcgaggctgctgctgcaggcggctcccggctctgccttcggccccgcccgccgcccaccaggctcccagaggccccgcagctcgcgccgtccggctccccgcagccccgtcgggcagcccgggcccgtccgctgccctcccggctcccgtcctgcggcggcggggcgtgcaggtgaggccccacggcgcccggcctctccagcagtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaa

SEQ ID NO: 25620 - DNA, 667 bp, Homo sapiens
cctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgc

SEQ ID NO: 25621 - DNA, 416 bp, Homo sapiens
gtataacagaaaaatgaaccaagcactgtaagagctaagtccacctgacaactttgtcttgaagaaaagattaatgaaagccacagtgagatacactgtcactccctgccccgcttccgcagggcccctttccagattggagatttctggcacgataaatgatgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaag

SEQ ID NO: 25622 - DNA, 2746 bp, Homo sapiens
cctagtcccagcccagggggccgctctcgccggcgtcgagggcgtggcggcgaggctgctgctgcaggcggctcccggctctgccttcggccccgcccgccgcccaccaggctcccagaggccccgcagctcgcgccgtccggctccccgcagccccgtcgggcagcccgggcccgtccgctgccctcccggctcccgtcctgcggcggcggggcgtgcaggtgaggccccacggcgcccggcctctccagcagtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctg

SEQ ID NO: 25623 - DNA, 658 bp, Homo sapiens
aaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctg

SEQ ID NO: 25624 - DNA, 4079 bp, Homo sapiens
agttgtcttgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtcttttttttttttttttttttttttttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatggaatgggtattattcattgtagttgatcctggtgtgtgtattatataaagagacccctccccttattttgtgttttccatccctctcccttaacaggattgaaataaaacatgcttctgtttttgtaaaaataatttttcctttacactggagattttattctatcagtatatgggtaactaggcactttggtcaggtgatccttgtcatgcctgcttctcccctctgtctacctacacaacacacacacacacacacacacagccctgctaagatggcagtagtggttcttttgtgaacatgttttttggggagactccatctgaggtacaaaagctgtttgggaggctgggagggggatgatgccccttacctgataaaagtatgttttactgggacagaacttcactcctggccatattggccagaacttagtgccagtgtagggagagacttccatagtgacaaggtaatgcttgaaacatcttacgaactttgatgttcatttcctcaagttcaaggcttggagcacatctccaggattgtttccatgcctggctgtcagtgggacacagctgccctatgcttccacgttcttttttcaagagccttagagggcctgtggcctgtttcactggtggaacaggagcagcattggtagccttcagagcatgccttgcttactaactacatattattcctctgctcattgttcctgctgcttaaaggctaggaaaagggggatatacaaagttgttgctttcaaaaactcagagaaaaaa

SEQ ID NO: 25625 - DNA, 1621 bp, Homo sapiens
agttgtcttgccgggactgtccatcttttcccgccgttcactggcttttggaggagggtcagagttcacgccgctctctggaaataactgctcaaagccagaagttgcggggactagtggtcgcggacgtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattgtagagacggggtttcaccatgttggccaggctgatcttgaactcccgacctcaagtgatctgcccgcctcggcctcccaaagtgctgggattacaggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagcccca

SEQ ID NO: 25626 - DNA, 3259 bp, Homo sapiens
gtccttccggtcctaaatcttaaggggcaaaggacatactctgggactgttaactaggccctggaggcgggaagaggatgtgtgggtggggtcaggggtgagaggtcagagggccgcgaagtgggcggagcgagccggagtcggatggcggctacggcggctcattgttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccagggcacgtgaagcactcagacagtgcctccctgaccagctgaaagacacaaccttcgcccaggtgctaaaagatgacaccaccacgaaacgctggcttgcacaactggtgaagaacctgcaagagggccaggtcaccgatccccggggtatccccctgccccctcagtgatccttccctgttccctcccactactcccccaagttggggaaaggagggggaacctacgagaaaaacagctcaggttttatcaccgactgggaatagacaacctcaatgctgaaccgcactggagaaaaggggcaaggtacccctgctgaggtgtatgggctgccatctcaggctgtcttgaggacctgggctccctctgctactcccaggaaatgggctcctgacacagcagtctgccaccacagccccaggagggtgtcaacaccagcaaatgctgtatttgcagcatgtccaagatgacccttctcccctacctctacctagccactggcagggaggggagacagtggtgatagcagcagcactctaggcatggtgaacgcctgggaccaagccatgtggcgttttttattttgcctttctggaagactcaagatatgtctcttcattctctctcagtatttgtttactttggtttttttgtttttaatctcagagagaggtgtgtttagtgggcacaagctgtaatattcagcaaaactttgtcgactggcactgtttacaagtctgttagctgcataagctcaataaaaagttggtctgggcattacatcccctctggcaggccaatagctgcatcaagctgttgggagaaatgggagggcaggggaaagatgtaaagccaaagtacagcaggaacccaccacctgtttcccttccttctcccattctactcccagtccggaatgccacgaggaccttaaccttgtttctggctttagctgctagttttcccaaatctcagtgctttccctttttgaacttcccttctattaaacttaaaacagatgtcttaattaatcaggctgtcttggaagggtattgtattgggagacaaggggcggtggtggacctcaccttcaatccaagttttcaaagatattttctcaataactctaaaagggaggtgcttgggattaaggtgacagtccacttgatccttttctttgttttagtgtgaatttcagcagctccatctgtcttcatgattgtacttgagcagtattagctgtatgagttaattttattcagattgaagatggagggctgggttctgctcactcagtcttttttttttttttttttttttttttttgaccattctcttttagtctatgggaattacagggttgccgctaaaatattcacttgttcatatcgtgtcagagatttcctcttctctggagcttaggtggctcttcacaatccataggcttgaatctgcaacctagtgtaaactgccttgctttccccggttctttcccctgctagcacctgctttctcatccctatctccagtcaaagatgggattgcttaatccaactctggagagggaccaagtcttttctgcccacatctcacacaattgaggtgtctgaacaagcttggggagggtctataaggggtaggctcaaaaaaaaaaaaacccatttgcagaggcagttttgccaacacaagggctctttcaagccgactttcacaaagagagccggacttgttagttggcttctgtctctttagagccaagaaaatagtaattaagtggcctagatataggaagggcagaataagcacttactccccctgccttccaagatgaagaggagaagcaggccaaccctcaataattgcaagcctgaagagaagtgatcttagagaaagcagagaacagaatggactggatagacatcttgactctattcagcccgtagtctgtgatctggagagtccagttaaggtaacccagatttttgacaaccgccttcctgctgagccaaagttttctcattacccctccactggggaagcagctgaggcccagggccttgctccctgggaaattctcttctctccatctttcggtgcattggccatgttactgtgccaaagtgtcttaattcttgtcccatctattctcagctggccttggaacccacataggagttggtgggggagggatgtgtattatataaagagacccctccccttattttgtgttttccatccctctcccttaacaggattgaaataaaacatgcttctgtttttgt

SEQ ID NO: 25627 - DNA, 1129 bp, Homo sapiens
ttttccgctgcaggggtgctgaaggggggacgcgggtcggacgcgtccggctgtggaagagagcggcggccgctcacaacatgcacagcctggcgacggctgcgcctgtgcctactacactggcacaagtggatagagaaaagatctatcagtggatcaatgagctgtccagtcctgagactagggaaaatgctttgctggagctaagtaagaagcgagaatctgttcctgaccttgcacccatgctgtggcattcatttggtactattgcagcacttttacaggaaattgtaaatatttatccatctatcaacccacccaccttgacagcacaccagtctaacagagtttgcaatgctctggcattactgcaatgtgtagcatcacatccagaaaccaggtcagcgtttctcgcagcacacatcccactttttttgtacccctttttgcacactgtcagcaaaacacgtccctttgagtatctccggctcaccagccttggagttattggggccctggtgaaaacagatgaacaagaagtaatcaactttttattaacaacagaaattatccctttatgtttgcgaattatggaatctggaagtgaactttctaaaacagttgccacattcatcctccagaagatcttgttagatgacactggtttggcttatatatgtcagacgtatgagcgtttctcccatgttgccatgatcttgggtaagatggtcctgcagctatccaaagagccttctgcccgtctgctgaagcatgtagtgagatgttaccttcgactttcagataaccccaggttttcagatttgactttctgctggtcatcttttcaaagaaaatgaaacgtttaaaagttcatctgataatactgctaccatagttttgttttcactgctcatctcttattaaggtttttaaccataaaactgaagcaatttctgtaaagacacaaattgataacttagtatagaattaaaattcattaagttatcataagtttgatgatatccttgttaatgtactgatttttgaattattttatttgccataatccatatatttctaacatgagtattttgacagtatttaataaatcagaaagctgtttgaatgg

SEQ ID NO: 25628 - DNA, 1485 bp, Homo sapiens
tccctgggactgcgtcactggtgcgcgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctgcgttccagttctcctacacagctgtcttcggtgcctacactgctttcctcttcatccgcacaggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaacatggccttgggcctttggg

SEQ ID NO: 25629 - DNA, 1379 bp, Homo sapiens
cgccgcgggtcagggcgcaatggcggcgctgggcggggatgggctgcgactgctgtcggtgtcgcggccggagcggccgcccgagtcggcggcgctgggcggcctgggccccgggctgtgctgctgggtgtcagtgttctcctgcctcagcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccagccaggcacatccctgctcaccctgatgggcttcaggctggagggcattttcccagcggcgctgctgcccctgttgctgaccatgattcttttcctgggcccactgatgcagctctctatggattgcccttgtgacctggcagatgggctgaaggttgtcctggccccccgctcctgggcccgctgcctcacagacatgcgttggctgcggaaccaagtgatcgccccgctgacagaggagctggtgttccgggcctgtatgctgcccatgttagcaccgtgcatgggcctgggccctgctgtgttcacctgcccgctcttttttggagttgcccattttcaccatattattgagcagctgcgtttccgccagagcagcgtggggaacatcttcttgtctgctggacacctgattgggccggttctctgccattccttctgcaattacatgggtttcccagctgtttgcgcggccttggagcacccacagaggcggcccctgctggcaggctatgccctgggtgtgggactcttcctgcttctgctccagcccctcacggaccccaagctctacggcagccttcccctttgtgtgcttttggagcgggcaggggactcagaggctcccctgtgctcctgacctatgctcctggatacgctatgaactctcaccggctccccagccctccccaccaaggggtactgcaggggaagggctggctggggtccccgagatctcaggaatttttgtaggggattgaagccagagctagttgcgtcccagggaccaagagaaagaagcagatatccaaagggtgcagccccttttgaaaggggtgtttacgagcagctgtgagtgaggggacaaggggcaggtcccaggagccacacactcccttcctcactttggactgctgcttctcttagctcctctgcctctgaaaagctgctcggggttttttatttataaaacctctccccaccccccaccccccaacttcctgggttttctcattgtctttttgcatcagtactttgtattgggatattaaagagatttaacttgggtaaca

SEQ ID NO: 25630 - DNA, 1405 bp, Homo sapiens
atagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 25631 - DNA, 1584 bp, Homo sapiens
aagtagaggcaacttccggtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacaca

SEQ ID NO: 25632 - DNA, 1566 bp, Homo sapiens
gtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacaca

SEQ ID NO: 25633 - DNA, 1566 bp, Homo sapiens; identical to SEQ ID NO: 25632

SEQ ID NO: 25634 - DNA, 914 bp, Homo sapiens
gtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacc

SEQ ID NO: 25635 - DNA, 765 bp, Homo sapiens
ttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggt

SEQ ID NO: 25636 - DNA, 847 bp, Homo sapiens
agccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtccttt

SEQ ID NO: 25637 - DNA, 765 bp, Homo sapiens; identical to SEQ ID NO: 25635

SEQ ID NO: 25638 - DNA, 765 bp, Homo sapiens; identical to SEQ ID NO: 25635

SEQ ID NO: 25639 - DNA, 1075 bp, Homo sapiens
cccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgc

SEQ ID NO: 25640 - DNA, 847 bp, Homo sapiens; identical to SEQ ID NO: 25636

SEQ ID NO: 25641 - DNA, 765 bp, Homo sapiens; identical to SEQ ID NO: 25635

SEQ ID NO: 25642 - DNA, 1075 bp, Homo sapiens; identical to SEQ ID NO: 25639

SEQ ID NO: 25643 - DNA, 765 bp, Homo sapiens; identical to SEQ ID NO: 25635

SEQ ID NO: 25644 - DNA, 1566 bp, Homo sapiens; identical to SEQ ID NO: 25632

SEQ ID NO: 25645 - DNA, 914 bp, Homo sapiens; identical to SEQ ID NO: 25634

SEQ ID NO: 25646 - DNA, 847 bp, Homo sapiens; identical to SEQ ID NO: 25636

SEQ ID NO: 25647 - DNA, 914 bp, Homo sapiens; identical to SEQ ID NO: 25634

SEQ ID NO: 25648 - DNA, 1075 bp, Homo sapiens; identical to SEQ ID NO: 25639

SEQ ID NO: 25649 - DNA, 1075 bp, Homo sapiens; identical to SEQ ID NO: 25639

SEQ ID NO: 25650 - DNA, 1075 bp, Homo sapiens; identical to SEQ ID NO: 25639

SEQ ID NO: 25651 - DNA, 1202 bp, Homo sapiens
gagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 25652 - DNA, 1566 bp, Homo sapiens; identical to SEQ ID NO: 25632

SEQ ID NO: 25653 - DNA, 847 bp, Homo sapiens; identical to SEQ ID NO: 25636

SEQ ID NO: 25654 - DNA, 1075 bp, Homo sapiens; identical to SEQ ID NO: 25639

SEQ ID NO: 25655 - DNA, 914 bp, Homo sapiens; identical to SEQ ID NO: 25634

SEQ ID NO: 25656 - DNA, 914 bp, Homo sapiens; identical to SEQ ID NO: 25634

SEQ ID NO: 25657 - DNA, 914 bp, Homo sapiens; identical to SEQ ID NO: 25634

SEQ ID NO: 25658 - DNA, 847 bp, Homo sapiens; identical to SEQ ID NO: 25636

SEQ ID NO: 25659 - DNA, 1566 bp, Homo sapiens; identical to SEQ ID NO: 25632

SEQ ID NO: 25660 - DNA, 765 bp, Homo sapiens; identical to SEQ ID NO: 25635

SEQ ID NO: 25661 - DNA, 1405 bp, Homo sapiens; identical to SEQ ID NO: 25630

SEQ ID NO: 25662 - DNA, 1405 bp, Homo sapiens; identical to SEQ ID NO: 25630

SEQ ID NO: 25663 - DNA, 1405 bp, Homo sapiens; identical to SEQ ID NO: 25630

SEQ ID NO: 25664 - DNA, 1405 bp, Homo sapiens; identical to SEQ ID NO: 25630

SEQ ID NO: 25665 - DNA, 1405 bp, Homo sapiens; identical to SEQ ID NO: 25630

SEQ ID NO: 25666 - DNA, 7300 bp, Homo sapiens
gcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtttgtaaggtatattacattttatattcatttatgatagcagacaaccttttaagattgctttaattagtatctgatgttgatttttaagtggcattcttttccttaggactttttatgtatacctgttgattgttgtgtaaattttagtaaatctaagagagtgtactaaaccagcaggtatctgttagcttatgtgtttaattgaaattagaaggctaagatggtataacagcattttattgctttgtccagctacaacttgtcatttttttctccatgtcttatcttcctgtttcactttagtttattcttcgttttttattgagatctataaaaaattggcttacttaatagcaaattacttgaagaatttgcctgctttatataaagttagcactttaagatttttttttttagagatgagaagacatttaaattgaagaaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaacca

SEQ ID NO: 25667 - DNA, 3225 bp, Homo sapiens
atggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggtaagagaccttcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaa

SEQ ID NO: 25668 - DNA, 1727 bp, Homo sapiens
ggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgccgcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaaaaaaaaaaaaaaaaaaaaaaaag

SEQ ID NO: 25669 - DNA, 6246 bp, Homo sapiens
gcctacgcgctggtgggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcaccca

SEQ ID NO: 25670 - DNA, 5297 bp, Homo sapiens
atgttttaccatgatcttttttatagggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcaccc

SEQ ID NO: 25671 - DNA, 2402 bp, Homo sapiens
actagaggcgagaaccggagcccattggtcggaacacctcacaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattacagta

SEQ ID NO: 25672 - DNA, 2307 bp, Homo sapiens
acaatggaccccagcggcgcgcaaaatccttatgattggtttgctggctgcctcgggagaccctgttgccaggatacttggcgttcccgacccgacccccgttccccattggctgtcagggcaaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagctatcttgttagaaatcccgcggctcccacctccagctcctgcagaggtggaaggaataggagaggcactgggtcctgaggagctgaggctgacaggctgggaacctggggccctactcatgaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattac

SEQ ID NO: 25673 - DNA, 635 bp, Homo sapiens
aaaagccgccatctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctgaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcaga

SEQ ID NO: 25674 - DNA, 2328 bp, Homo sapiens
atctaatgaggagcgaggtgcggtgccccgaagcgctcgcttcccgcggtgcgatctagtcctgcagtaggcggcccggggccacaccgcggccgcccaagccagtgcaaggcccaggggcctgacatcgctcccagcgctcgaggaccgaggcctgctgtggaggacaccgtgctccctcgggacctgctctggattccggcccggacgtccccttggagctctgcatctccaacctggaacccaacccagaagtctcaagtttgacgcatcacgtggcgtgcggatccactgagggtccacagagaggggcgcccatctcctgcgtctcagttatcctggtaattgtgtatctgcccattgttcgttgcctcattaacttggctttctaggtgcacccaccttgccaccagagaagtccaaatcctgacttctctccaaggtgttgggaattctgtgccctaaagaattccgactcagatccgaacggggatctggtggaatcgagggtgaaagaccagagggacaatgttctactatcccaacgtgcttcagcgccacaccggctgctttgccaccatctggctggcggcgactcgcggcagccggttggtgaagcgcgaatacctgagggtgaatgtggtgaaaacctgcgaggaaatcctcaattacgtgctggtacgagtgcaacccccgcagcccggcctgccgcggccccgcttctccctctatctctcagcccaacttcagatcggtgtgatccgcgtctattctcaacaatgccagtacctcgtggaggacatccagcacatcttggagcgcctccaccgtgcccagctgcagatccgaatagatatggagactgagctacccagcctgctgcttcctaaccacctggccatgatggagaccctagaagatgctccagatcccttttttgggatgatgtctgtggatcccagacttcctagtcctttcgatatccctcagattcgacacctcttagaggctgcaatcccagagagagttgaagagatccctcctgaagttcctacagagcccagggagccagagaggattccggtcactgtgctgccacctgaggccatcacgatcctggaggcagagcccatacggatgctggagattgagggtgaacgggagctcccagaggtcagccgccgagaactggacctgctgatcgcagaggaagaagctatcttgttagaaatcccgcggctcccacctccagctcctgcagaggtggaaggaataggagaggcactgggtcctgaggagctgaggctgacaggctgggaacctggggccctactcatggaggtgacccccccggaggagctgcgtctgccagccccacccagcccagagaggaggcccccagtccccccacctcctcgccgccgccgtcgtcgccggttactgttctgggacaaggagactcagatctccccggagaaattccaggaacaactgcaaaccagagcccactgctgggaatgtcctatggtgcagccgcccgagaggaccatcagaggccctgcggagttgttcagaaccccaactctctctggctggctaccccctgaactactgggtctctggacccattgtgcccagccacccccaaaagccctcaggcgagagctgcctgaggaggcagccgctgaggaggaaaggagaaagattgaagttccaagtgagattgaggtcccgagggaggccctggagcccagtgttccccttatggtgtctttagagatctccctagaggcagctgaagaggagaagtcccgcatcagcctcatcccaccagaagaacggtgggcctggcctgaggtggaggcgccagaagctcctgcattgcccgtggtgcctgaactccctgaggtgcccatggagatgcctttggtgctgcccccagagctcgagctgctctcactggaagcagtgcacagggcagtggcactggagctgcaggctaacagggagcccgacttcagcagcctggtgtcacctctcagcccccgcaggatggctgcccgggtcttctacctgctcctggtgctctcagcgcaacagattcttcacgtgaaacaagaaaagccatatggtcgcctcctgatccagccggggcccagattccactgaggttagagtccatttacaaagctgccaggaaaccggccacttctagtaaaccacgtcgtgcctcactgggtcctgcttacctcatttctgaatgtgcatttccagccttcttgctctcagagctattgttcaagcagaaaacaagctgcttttattaca

SEQ ID NO: 25675 - DNA, 1321 bp, Homo sapiens
tttctcatgggtgggcagccttggctgtctgccggaacgtaaagagcatggagcaaggacatgggaatccgaatcccgctgaggtcccaggaccacttcatccttcttccctgtgcctctcctccccagcatgagcacagcagcctgatggagaaggattttccaatgttagaactggaaagaacacctgtagcctgtctccaccgtttacagtggtgctggaagtgaaaagatgtgttccaggtcacaggcaggtagacagcggagccagactgaaattcactcctcctgatttggagtttagagctcttctttggcaacattttgatgaataaaatcacaagttctgtgtcttttgaaattccttgtggagcctagtgccatcctctgaacttggagccaactgacctttgtccttggggcagagacatggttcatgggcccaatccaggtcctcaaagggagggcaggtctgagtccttgccctctgaagtcagaaacctcatctcccactacagacctgccagggcccaggagagctcgacccacccaggcacaccatagccccagagatggctggggacacagaagtgtggaagcaaatgtttcaggagttaatgcgggaggtgaagccatggcacaggtggaccctgagaccagacaagggccttcttcccaacgtcctgaagccaggctggatgcaataccagcagtggaccttcgccaggttccagtgctcctcctgctctcgtaactgggcctctgcccaagttctggtccttttccacatgaactggagtgaggagaagtccaggggccaggtgaagatgagggtgtttacccagagatgtaagaagtgcccccaacctctgtttgaggaccctgagttcacacaagagaacatctcaaggatcctgaaaaacctggtgttccgaattctgaagaaatgctatagaggaagatttcagttgatagaggaggttcctatgatcaaggacatctctcttgaagggccacacaatagtgacaactgtgaggcatgtctgcagggcttctgtgctgggcccatacaggttacaagcctccccccatctcagaccccaagagtacactccatttacaaggtggaggaggtagttaagccctgggcctcaggagagaatgtctattcctacgcatgccaaaaccacatctgtaggaacttaagcattttctgctgttgtgtcattctcattgttatcgtggtgattgttgtaaaaactgctatatgagccttggaaacatgaagctaagtcagaaaaaaaatcagatacaaaaagtc

SEQ ID NO: 25676 - DNA, 1554 bp, Homo sapiens
gtccatacacagaaacagaaactgaaccgaacaccgaaactgaaactgtttgtctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagccatcctctgaaaacagtatgaaacatgaccaagtacataatggatttagtaataaatattgtcgaattgctaaaaagtcttcaatcattcattcactaagtcactcagtgatatcaatatacttagctcagaaagtgtgggaggctgaataatggtgtctcccaacatatgcatgacttaatccccagaacctgtaaacatgttactttacatggtagaatggactttgcggatgtaattaaggaccttgaaatggttagattatttcatattgtccgggtggataagaaccaggattttgtaacagggaggcaacaagctcaaaatcagaaaaaagagatttgtcaatggaacaagaggttgaagtgctttgaagttggaggaagaggtcacaggcaaaaaagtacaggcagcctttagaaacccaaaaggacaaaggaacagattctcccctggagtctgcagaaggaaccagccctgcctgcacatggctttagcccagtgacactgattttggacatctgaccttcagaactgcttgctcataaacttgtcttgttttaatgca

SEQ ID NO: 25677 - DNA, 910 bp, Homo sapiens
gcggccgccgcctcccaccgctcccgcgcccgctcccgcccccggcgcgtctcctccgggcccgcgccgcggcgggctcagtcctcagcggggcgcgtggcgagcggactcgactcggcaccgctgtgcaccatggcccgggccctgtgccgcctcccgcggcgcggcctctggctgctcctggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgaccttgacttacctctggaaagggtcccagcctagactgcttaccccatagccacatttgtggatgagtggtttgtgattaaaagggatgttcttgaacttggaaa

SEQ ID NO: 25678 - DNA, 650 bp, Homo sapiens
ggagagcgggcattctggaaagcgtgggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgac

SEQ ID NO: 25679 - DNA, 857 bp, Homo sapiens
gcagctgccagagtgccaccaaagcaaacctcatctcaagactctgtggccaggccctcacaacctcctgccaggctctcgctacctacccatcaacagcaagactcccaggccatctcaatccccccaaagagccctgttcctccagccccacggcttctgttcacctgccgtgctgtccccgcctctgcccacccactcatcctgcagatctggagcagcattccagggcctgcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctggaagcccccctggctggaggccaccgccaccctaggaagggggcagggacgtgac

SEQ ID NO: 25680 - DNA, 734 bp, Homo sapiens
agtcctcagcggggcgcgtggcgagcggactcgactcggcaccgctgtgcaccatggcccgggccctgtgccgcctcccgcggcgcggcctctggctgctcctgggcaggatagcctgaggcacgcttgcttcactcccaggcagaatggccactgagaaatccggcccatcacctcttcatgaccactgcctgccaggaggctaactacggtgccctcctccgggagctctgcctcacccagttccaggtagacatggaggccgtcggggagacgctgtggtgtgactggggcaggaccatcaggagctacagggagctggccgactgcacctggcacatggcggagaagctgggctgcttctggcccaatgcagaggtggacaggttcttcctggcagtgcatggccgctacttcaggagctgccccatctcaggcagggccgtgcgggacccgcccggcagcatcctctaccccttcatcgtggtccccatcacggtgaccctgctggtgacggcactggtggtctggcagagcaagcgcactgagggcattgtgtaggcggggcccaggctgcccgcgggtgcacccaggctgcagggtgaggccaggcaggcctgggtaggggcagcttctggagccttgggacagagcaggcccacaatgccccccttcttccagccaagaagagctcacaggagtccagagtagccgaggctctggtattaacctgg

SEQ ID NO: 25681 - DNA, 781 bp, Homo sapiens
ggatataggcgcccccacacccgggcccggctcagcgccgccgccgctcctcgcctccttgctgcacgatggcctcgctccgggtggagcgcgccggcggcccgcgtctccctaggacccgagtcgggcggccggcagcgctccgcctcctcctcctgctgggcgctgtcctgaatccccacgaggccctggctcagcctcttcccaccacaggcacaccagggtcagaaggggggacggtgaagaactatgagacagctgtccaattttgctggaatcattataaggatcaaatggatcctatcgaaaaggattggtgcgactgggccatgattagcaggccttatagcaccctgcgagattgcctggagcactttgcagagttgtttgacctgggcttccccaatcccttggcagagaggatcatctttgagactcaccagatccactttgccaactgctccctggtgcagcccaccttctctgaccccccagaggatgtactcctggccatgatcatagcccccatctgcctcatccccttcctcatcactcttgtagtatggaggagtaaagacagtgaggcccaggcctagggggccacgagcttctcaacaaccatgttactccacttccccacccccaccaggcctccctcctcccctcctactcccttttctcactctcatccccaccacagatccctggattgctgggaatggaagccaggtggggtcatggcacaagttctgtaatcttcaaaataaaactttttttttgt

SEQ ID NO: 25682 - DNA, 1323 bp, Homo sapiens
agcgggaccgagcgtgacccagctgcggccggccagccatggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccggtgagatggagtgggtcacacctggcaagctggaagaaagttccctggggatgggagagcgggtgggtgctgccaatctccagctactgtggccacaccccacctggtcatgggcagacccctcccttcctgggctgacctgctccctcgaggccagcctgctccctggctgaggctcaggctatccgcccaagctctttgctcattctagggccagtggaggaaaatgtgataaggccagagcttgtgtgctgggcacagaaatcacctgctgcatcctgtgctccgcaggctgggccggagcctctgcccgcaggtttctatgctgtttcttagcacagaatccagcctagccttagccgcagtctaggccctgcttggactaggactccttgcttgaccccatctctggttcctgccctggctcctgcaccagccccagctcctgcctacatccaggcagaaagataggcaggggctcttggaagacgttccgtgctgtgacctccgagccctcctggtgggaagacagctggaaaggctgggaggagaagggaggggctgggggttcccaggagccatgcgtggcctgcagagtccattccatcatgatgctgtgcccgctatgggctgtgtccatgaccagaggctggagtgggggtgtgttagagcccctcaccgggacttgctgtgcggatggggcctgggcctccttcctacaggggctcctctgtgggtgaggggccctctggaatggcatcccatgagcttgtggcctctatctgctaccatctgtgttttatctgagtaaagttaccttacttctggaa

SEQ ID NO: 25683 - DNA, 559 bp, Homo sapiens
atggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctgtgagggtcccgatgtggaaattgaggctcagaaatgtaaggggacttgctgaagagtggtcttttatattttcctggcctgctgccctactgaatccagccctgagaggtgacaa

SEQ ID NO: 25684 - DNA, 543 bp, Homo sapiens
atggagactggagcgctgcggcgcccgcaacttctcccgttgctgctgctgctctgcggtgggtgtcccagagcaggcggctgcaacgagacaggcatgttggagaggctgcccctgtgtgggaaggctttcgcagacatgatgggcaaggtggacgtctggaagtggtgcaacctgtccgagttcatcgtgtactatgagagtttcaccaactgcaccgagatggaggccaatgtcgtgggctgctactggcccaaccccctggcccagggcttcatcaccggcatccacaggcagttcttctccaactgcaccgtggacagggtccacttggaggaccccccagacgaggttctcatcccgctgatcgttatacccgtcgttctgactgtcgccatggctggcctggtggtgtggcgcagcaaacgcaccgacacgctgctatgtggaaattgaggctcagaaatgtaaggggacttgctgaagagtggtcttttatattttcctggcctgctgccctactgaatccagccctgagaggtg

SEQ ID NO: 25685 - DNA, 3857 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttcttttaaaaaa

SEQ ID NO: 25686 - DNA, 3778 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 25687 - DNA, 3735 bp, Homo sapiens
gtttcttatgcagaaagtgctgagcaacggacagactgaagaggttaggtctggatccaggcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 25688 - DNA, 991 bp, Homo sapiens
agtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatattcctttcgactaatgcgcccattttgttcaagagagaaacctgcgagtttccttaacacacccacacccacgccccacccagttggtgaccatgtcccttcatccctgtcgcctgaataatcttccaaaccaggtcaaatggatgatgtactggattatatttgcacttttcaccacagcagagacattcacagacatcttcctttgttggtttccattctattatgaactaaaaatagcatttgtagcctggctgctgtctccctacacaaaaggctccagcctcctgtacaggaagtttgtacatcccacgctatcttcaaaagaaaaggaaatcgatgattgtctggtccaagcaaaagaccgaagttacgatgcccttgtgcacttcgggaagcggggcttgaacgtggccgccacagcggctgtgatggctgcttccaagggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatag

SEQ ID NO: 25689 - DNA, 3616 bp, Homo sapiens
aacgccgggcagggcggcgggcgcgctcagtctggcggcggctgccgtgagctgactgacgttccgggaacgccgcagcagcccgcgccgcccgcagcctagccgagccgcgccgcccgggcctcgcccgcccgcctgcccgccatggtgtcatggatcatctccaggctggtggtgcttatatttggcaccctttaccctgcgtattattcctacaaggctgtgaaatcaaaggacattaaggaatatgtcaaatggatgatgtactggattatatttgcacttttcaccacagcagagacattcacagacatcttcctttgttgggacagggtgccttatcggagagactgcggagcttcagcatgcaggacctcaccaccatcaggggagacggcgcccctgctccctcgggccccccaccaccggggtctgggcgggccagcggcaaacacggccagcctaagatgtccaggagtgcttctgagagcgctagcagctcaggcaccgcctagaatccttcgatctcgcttcaggaagaaaagtacctcatcctcggccaccgaaaccacgtgagtgagatgagccaacagcaccggatccacagaatgtttcttctctgccttaaagagctattcactaataacatagaaatccgcaagctgggtgtgctttgagtgtgcagcctcacaaacatggccttttctctctccccttccacttttaaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgttctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttt

SEQ ID NO: 25690 - DNA, 2099 bp, Homo sapiens
gctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctcattta

SEQ ID NO: 25691 - DNA, 2170 bp, Homo sapiens
cacggcccgccgctgcggcagggacctcccctttaacggcggcgctgggcgctccgctgcccccgcggcggctgctgcagcggctgctgctgctactgcggctcctgctgccgccgccgccgccgctcggcctcaggcagctgcatcctcggccgggccgggtccccgccccgcgccgcgcccggccccgccatggtgtcctggatcatctctcgcctggtggtgctcatctttggcaccctgtacccagcctattcttcctacaaggccgtgaagacaaaaaacgtgaaggaatatgtgaaatggatgatgtactggatcgtctttgccttcttcaccacggccgagacgctcacggatatagtgctctcctggttccccttctactttgaactgaagatcgccttcgtgatatggctgctgtccccttacaccaagggctccagcgtgctctaccgcaagttcgtgcacccaacgctgtccaacaaggagaaggagatcgacgagtacatcacgcaggcccgagacaagagctatgagaccatgatgagggtgggcaagaggggcctgaaccttgccgccaatgctgcagtcacagctgccgccaagggccagggggtgctgtcagagaagctccgcagcttcagcatgcaggacctgaccctgatccgggacgaggacgcactgcccctgcagaggcctgacggccgcctccgacccagccctggcagcctcctggacaccatcgaggacttaggagatgaccctgccctgagtctaaggtccagcacaaacccggcagattcccggacagaggcttctgaggatgacatgggagacaaagctcccaagagggccaaacccatcaaaaaagcgcccaaagctgagccactggcttccaagacactgaagacccggcccaagaagaagacctctggcgggggcgactcagcttgagcccctccacccccgcaggctgcagagcaaggatgaagcctcaggaggggcctcagacccagcccctgctccacactgtgccagtagcctaggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggcctccaccgctgttccgctgcagccccgccctgccccacccacccagtgccttgctgaagcccatagcaatccgcttctcagaggtcctgtcgtgtttccactgctcgccttggtttgggagcagggagggggaagtcctagcccagatggaccaaggacgggcctgaaggcacatgggggaaagggagcacacggggaggacgttggggaccctgggtggggcctccaggtgcagctgtggatggaagacagggattggcctgtgcttcagcgaccaggatggccaggccagagctgcagctgggggctcttttcctggtcattgggtggggctgagtgccacatgttcccacattaaaaaggggggtccagggctgtgtgagtgtgtctttctgggtctagggctcggggtagtttgggtcaaggactgtccctccagcagtcgcctcctcccaccctgagccccacagtcatctggccctttccctgctcaaccctccatcctaggctctgagcctcagaggacccagcccatgagagaacggggatctggggggcctctcacctgctcctatgaccttgctcccttttaggtcaccccattgccaccgtgcccctgggctggactcccgtgctcctcagggcccacccctgctctgtctggtacaggcccctgctgagtgggcccctctcctctgcccctggggtccatcccctcttgcccagggtccccatcctgtaccaagcagactgggccctaagacccctggcagaacccagcctctgctcacacccgccccagcttctgccacggcttcagtcagggccaggaggaacacgtgaaggagaaagagaaatgcaggagccgcggggctcccggttccttgggaagagggtgcccattggacctttggcactggatgagccaataaaccaaactctggcacctc

SEQ ID NO: 25692 - DNA, 5115 bp, Homo sapiens
cggctcctgagggcgccagcgcggccccggggagcgcgaggagccggcgaagcgcgcggcctgccgttggcggcctggtccgcagcgccctgcgcccacccgccccggacgtggggcccaagcccccgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttctgtaacaattgcttccaaatattgactactaaaggcagttctgcaagatgtactaaatatgtatattagaaattatagaaaatcatgttgtccgttttcaaattcatcaacagcctagagtgcctgagatataagatgaaacacaaatccacagtatacttgaaaggagcctttttacggttcaggataaatcagcctttgtgatgtactgtgtttacctccttttgtgttgtatctggtaattaaataggcctcagattcagcagtgacataacaaggacataatgtaagataataaagtaggttttatatattctttaaatttttacttatataatactttctagtttttccaccatcagctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttaccttttttttttttttttttttgagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtatttggctaaaaaattatactgccaaaattactgattataaatacttgactacactgattgatgggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaattcgcgtttctttttttatgccagagtacatatgttggattccatgaattggtattacttattattatgtgttgattaaatatatgcacacacttaggattacagatcacagagcaaattatgaaaatcataaacattctggtatggtcatccataggattatgaaaaagaaatactgaattgttaaatttggatgttagaaaggaaagataggaaaaacaatgagtacagaaatcctcaccatcaatttggatgggttagctgtctcaggcataaaatgtaacacaaaattcagatttatgtatcctggaaatgttctggggttccatctgttttaaagttagacgtctgtctgcctcacatttaagctttagagagaaatcctatgttttaagaagtttctttgtgttacttcattatgacacataatgcgtgttaaggtctttctagatagcattttaaatggaattattttcattttcattatgaggtatatacttgtaatgatctaaagaggttagaaatataaataaaaattcaaaag

SEQ ID NO: 25693 - DNA, 5205 bp, Homo sapiens
gggggaccgacctctgcgcagcccaggccgccgcgcgcacacaccgggcccggctcctgagggcgccagcgcggccccggggagcgcgaggagccggcgaagcgcgcggcctgccgttggcggcctggtccgcagcgccctgcgcccacccgccccggacgtggggcccaagcccccgtgaagatggtgtcctggatgatctccagagccgtggtgctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttctgtaacaattgcttccaaatattgactactaaaggcagttctgcaagatgtactaaatatgtatattagaaattatagaaaatcatgttgtccgttttcaaattcatcaacagcctagagtgcctgagatataagatgaaacacaaatccacagtatacttgaaaggagcctttttacggttcaggataaatcagcctttgtgatgtactgtgtttacctccttttgtgttgtatctggtaattaaataggcctcagattcagcagtgacataacaaggacataatgtaagataataaagtaggttttatatattctttaaatttttacttatataatactttctagtttttccaccatcagctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttaccttttttttttttttttttttgagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtatttggctaaaaaattatactgccaaaattactgattataaatacttgactacactgattgatgggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaattcgcgtttctttttttatgccagagtacatatgttggattccatgaattggtattacttattattatgtgttgattaaatatatgcacacacttaggattacagatcacagagcaaattatgaaaatcataaacattctggtatggtcatccataggattatgaaaaagaaatactgaattgttaaatttggatgttagaaaggaaagataggaaaaacaatgagtacagaaatcctcaccatcaatttggatgggttagctgtctcaggcataaaatgtaacacaaaattcagatttatgtatcctggaaatgttctggggttccatctgttttaaagttagacgtctgtctgcctcacatttaagctttagagagaaatcctatgttttaagaagtttctttgtgttacttcattatgacacataatgcgtgttaaggtctttctagatagcattttaaatggaattattttcattttcattatgaggtatatacttgtaatgatctaaagaggttagaaatataaataaaaattcaaaagaa

SEQ ID NO: 25694 - DNA, 5028 bp, Homo sapiens
ttaatgatgtggcttctagttgagagggccttaatccagctggtgtttggaatgctttatcctgcatattattcatacaaagctgtgaaaacaaaaaacgtgaaggaatatgttcgatggatgatgtactggattgtttttgctctctatactgtgattgaaacagtagccgatcaaacagttgcttggtttcccctgtactatgagctgaagattgcttttgtcatatggctgctttctccctataccaaaggagcaagtttaatatatagaaaattccttcatccacttctttcttcaaaggaaagggagattgatgattatattgtacaagcaaaggaacgaggctatgaaaccatggtaaactttggacggcaaggtttaaaccttgcagctactgctgctgttactgcagcagtaaagagccaaggagcaataactgaacgtttaagaagcttcagtatgcatgatttaacaactatccaaggtgatgagcctgtgggacaaagaccataccaacctctaccagaagcaaaaaagaaaagtaaaccagcccccagtgaatcagcaggttatggaattccactgaaagacggagatgagaaaacagatgaagaagcagaggggccatattcagataatgagatgttaacacacaaagggcttcgaagatcgcaaagcatgaaatctgtgaaaaccaccaaaggccgcaaagaggtgcggtacgggtcactaaaatacaaagtgaagaaacgaccacaagtgtatttttagtcatctacacgtcaaatatcccaagacagattatgctaaatacatcgacttcatcttctaacatgatatattcaggatttacacattaaaatgattatttaaattgtggcagtgatggggtttactttcatgaatttaaattgtttttatttctgtaacaattgcttccaaatattgactactaaaggcagttctgcaagatgtactaaatatgtatattagaaattatagaaaatcatgttgtccgttttcaaattcatcaacagcctagagtgcctgagatataagatgaaacacaaatccacagtatacttgaaaggagcctttttacggttcaggataaatcagcctttgtgatgtactgtgtttacctccttttgtgttgtatctggtaattaaataggcctcagattcagcagtgacataacaaggacataatgtaagataataaagtaggttttatatattctttaaatttttacttatataatactttctagtttttccaccatcagctgaaagtttttgaaacaaatatttgaaaaccaggtatccacacatagcacttttattcctgactagttttgcacacttgaaaattgtttacttattttacaactgttttactgatgctatctttattgtttttgccgtattctgacatgtcaaatctatgccttgaattatatcatctcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttaccttttttttttttttttttttgagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtatttggctaaaaaattatactgccaaaattactgattataaatacttgactacactgattgatgggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaattcgcgtttctttttttatgccagagtacatatgttggattccatgaattggtattacttattattatgtgttgattaaatatatgcacacacttaggattacagatcacagagcaaattatgaaaatcataaacattctggtatggtcatccataggattatgaaaaagaaatactgaattgttaaatttggatgttagaaaggaaagataggaaaaacaatgagtacagaaatcctcaccatcaatttggatgggttagctgtctcaggcataaaatgtaacacaaaattcagatttatgtatcctggaaatgttctggggttccatctgttttaaagttagacgtctgtctgcctcacatttaagctttagagagaaatcctatgttttaagaagtttctttgtgttacttcattatgacacataatgcgtgttaaggtctttctagatagcattttaaatggaattattttcattttcattatgaggtatatacttgtaatgatctaaagaggttagaaatataaataaaaattcaaaagaa

SEQ ID NO: 25695 - DNA, 1710 bp, Homo sapiens
acactgcgcctgcgtggcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggc

SEQ ID NO: 25696 - DNA, 1476 bp, Homo sapiens
gctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctacgagaccgtgctcagcttcgggaagcggggcctcaacattgccgcctccgctgctgtgcaggctgccaccaagggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggc

SEQ ID NO: 25697 - DNA, 3318 bp, Homo sapiens
gtccgatttgagaaggggacccacgagagacacaaaatgcacgcccccacgccacatcctttttaccccgcaatgggttaagactgtcaacaggcaggccacctcgcagcgtccgcggagttgcaggcccgcccccgccagggtgtggcgctgtccccctggcgctgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactcgactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtacaaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttatcacctatcctgaagatgtgatacactgaatggaaataaatagatgtaaataaaattgagttctcattt

SEQ ID NO: 25698 - DNA, 1187 bp, Homo sapiens
ggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaaggtgtggtctggactagggtttctccttccccgctgcctgctgtagtagtggtcgtggtggcccatcttctccctcctctcggagttcttgccaaaggaggagccagtctgatctgaagacaagtagatgtctctattagcttcccagaattcattgttgggatttctgaacacatgaagaaagttgcagtgttttcctcttggacattgttgtatttcaaataaaccacaaatcgccattttccaccgggtcactgggcagaattcacattgcagctgtcgtcctgcataccatcgtccgttaaacagagaaagggctgcttggcattcttcttccgactggtactgaacatatacattgcccctcagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgt

SEQ ID NO: 25699 - DNA, 1517 bp, Homo sapiens
ctctcccggcggggtctgggcagcggcggccgtggcggagggctatgcggcgggggagacggggcaggcccctcctcctttgtccgccctgccctcccattggtcctagcggggggccgggggcggacaccggcgcggggccggagcatcgcggctcaggctgcgggaaagcggtgcgcgtgcagcggggtgggtgccctggtccgcgggcgagctcgagcagccaaccccgggcgcgtcggggccatggacggcctgaggcagcgcgtggagcacttcctggagcaaaggaacctggtcaccgaagtgctgggggcgctggaggccaagaccggggtggagaagcggtatctggctgcaggagccgtcactctgctaagcctgtatctgctgttcggctacggagcgtctctgctgtgcaatctcatcggatttgtgtaccccgcatatgcctcaatcaaagctatcgagagcccaagcaaggacgacgacactgtgtggctcacctactgggtggtgtacgccctgtttgggctggccgagttcttcagcgatctactcctgtcctggttccctttctactacgtgggcaagtgcgccttcctgttgttctgcatggctcccaggccctggaacggggctctcatgctgtatcagcgcgtcgtgcgtccgctgttcctaaggcaccacggggccgtagacagaatcatgaacgacctcagcgggcgagccctggacgcggcggccggaataaccaggaacgtcaagccaagccagaccccgcagccgaaggacaagtgaagcagccccctgagcctcacaaggacctcctggctggtgaggagggggccgcgccaggctcccaggcctccacagagtcttcagcgcatcccccaacagcagcccctgccagtccctcgggtccaggcaaggccctgggggtctccttaaatgccacctcgggcaagtcccagtcccagtcctcggccacccccagctctggatcccagggccagctgccctctggctctggctgtggctcccgcctgtccggcagggcccagggccagcgtcgggcacagggcagctcccactggtctcggcaacacacccagccgcctggtacttcctccagcccctcccagtcagccctcccgtcctcggggcccctgcagccacccaacgtcacctccagcccggtctcacccatggtccagtctcccagcagcagcaacatccccacgcagccccccagcaagtcctctggcaagccggaggacgcagcccccaagaccagcggacagcgccagaaggaatcgtcgaaacagcctgccagcagcgcctcagtgcccgagctggtcccctgccattccgggacctctctggagtacacttcggagtccaccaccgagatcacctgcagctggccacaccacaggcccccgtgcctgcagcactactggtgcctgaaacacctggcctgctaggaggctccaataaagctaacccggaccaga

SEQ ID NO: 25700 - DNA, 5832 bp, Homo sapiens
gagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccagaaaaaaaaaaaaaaaaaaaaaacaagcaaacaaaaacattgtgggatgtgcactccattggagtgcatgacatggcattgggattggaacatgtggtttcgagcactgaaagctgcaaaccagtgaagaggaaaagaaccttgtgattaaatataaaaccaaaagtcaaatggtgctttgtgttttagccttcagtcaccatgactggtctctcccccagatgtatatataccatagcatttgtctacctgctgtcttttcttcaggacagatgttcaggaattatattgattgaatttagactctgtgcatgttcttatggaaatgatgttcagaatccatgaagaaacttcaggccaaatttgaaaccctggagggaaatgagccataagggaagtataacaagccctgaagccttttatgtcgttgtgcttctttgggaaggtgtagagtgtgcctttttgtgaatcctcctctgatcatgagggtctttcccacagtttctcacagtgtgtttacactgcccttggaataacacagcgcatcagaccataagaaggctagatgtggatgctagaattgattgttggttgatagttctctttgctggattaggaatgaggcgccaaaggaagcacagccaggaaaatggccccacagcctagatcagcatctgtgggaaaggaaaaagggttcccatggggacagcccccataggagttttctggaaccagtaacactgaaaaataagtgtgtggctacagatgagcacgcccaccccttgcaactccctgtttacaagttgtccgaggcattggagtgcttatggtcaatgggctctagggaagtaggaaactccatcatgatacaaatgtctagtaattttaaagtttctttccctttttttctgtgctggaaatgttcacagatttgattcccgccccaagaattacaacaatgtattcatacagtcagttggaatccaaaggcaattaattctattttgcaaaatatgatggtcttcctaaaaaacaagtactgagttctcatttcaaaagttaccaagaactgaattctttaaactagcaaaccgaagtaacatgaccatttttgccttagtgggaggtttcaaatgtgcagctcatggcatttacctgccgaccatcttttgccaagtttagaattcttatgcgtttcaagttctatatagaaagtaattttacttttgatttttctcttgttaaaaaaaaactcctttattctaagaacaatgtctcaaagtctcatttttactttaaaggtataagagacttctaaagagacttacgggatataaaagtaattcctggaaatgatatttgatgaggagaatgtaagagaatgaaaaacacattgatgttttcatttttaaaaaatacaactagcatgagaaatcaagaaaatatgtttaccaaaatgcattgcaattttcccaaacctgagtcttcaaataacaaacatgaacttataggtactgtgaactagaagaattggttatatccagatttctgggagataaattaaaacatatttttgtggcataaataagctgattcagaagttacatttcttaactttaggtagaggagaatatttgtatccttttgttgctatgcaactgtttaatgatgaagcttcaaaccacaattttgtatatcatatgacaatcaattgttttccaagaatatttattattttaagtacacaatttcagtgaatcttgagtttttctaggagtcccttaaagggaaattagcattccatgagccagtaaaatacctactctggtaaaacattattatggttaaaaagtaaattcaagttagttttttataaagaactataacatttattttaaacattttataataactgaaaacattaaagtgagcaaatgaaatttcaaaaccacttgtaataatgtattttataatcgcactgtgatactatataacacagtctcttttgtattaaaatagtatttttttcacaagctgaaaaatatcttttcctttgttgacaatgttttgtaagatgactttattttcagatctttttctccttttttgcacaaaactatgcttatggtttgtgtcacagaagtgaaaatatatctttgcatttttatatctggtctgtttttcttgtttcctttgtttttaacttgatatagattttcttcaaatatataatggcaattttcagatatctcaccttaccatatctttccttattttcactgcatgcatttaatcactgtattacttaatgtttgatttgttattatgggcatttcaaataggcaagcattgaattgtaatgacaaaaaggctattttatattaaggatatatgcatttgtatttcacacaccagagatgatattaaacactgattattttatgctgctgtttattaaaaatgtttactataaaa

SEQ ID NO: 25701 - DNA, 2305 bp, Homo sapiens
gagcgagagagggagcgtggagagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcggtaaatagaagtcattgcccctaatgtattcaatcatctttaaagatccctatcctacccctcttatttaggagaatcctataaggggggcaaagaaaatggacagtatttgcttgatctcaatctggttttagggtaaaccttgccgtttctacataaaacacctcgtaaggtaccaaaacacgttctcaagaagtcaactgcctttatacctgcagccattgcactcatggatgtaacagggacccagcccttcagaggcacagttgagacagtttatcacattgatttttatagaaaaagatgttacccagaatggtctgcgtccaagtggaccttttcagcaaaaaaaggaatattggaagcaggaagaaattgttttctgtatgccttaagaacaccacaaggcaggatgaatctacaaccattactcggtcatccaggacaatctgtgggtaaactgtgtccttcgttatgtctgttaatactgcagaagaagcatataggtatctagtaagaaaatggaattcctgagtcagttaactgttcctttttctagaaaatgtttggagaaaataatgaaaatgggccaagcatggtggcttatacctgtaatcccaacactctaggaaggccgaggcaggaggatcatttgagcccaggggttcaagaccagcccaggcaacatagtgagactccatctctaccaaaaaaaagaaaaaaaaaaaaagaaaa

SEQ ID NO: 25702 - DNA, 2823 bp, Homo sapiens
agagcccgtggatgttctgcgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaa

SEQ ID NO: 25703 - DNA, 2624 bp, Homo sapiens
gctgaccctggtctgaagctcatttgaccaaactgagcaagaagtgcacaagtttcttgcatttccttccagacctctagtagccctgacacacatcctggactaatcaagactatgtgaaacagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcgtgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtagagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggacggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 25704 - DNA, 4096 bp, Homo sapiens
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccggacacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgccccgcacacattgttggtcctatttgtaaatcccacacccggtgtatccaataaagtgaaacaaagcatgtg

SEQ ID NO: 25705 - DNA, 1671 bp, Homo sapiens
cccaactggcagcgacagctgcagacgggctgaaccagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagacagccttccccaggtacgactccgccatgagcatcatgaccgagatcggaaaccgcctggggcaggtgcaggcgctgctgggtgtggccaagtgctgggtggccaggaaggcgctggacaaggctctggatgccatcgagagagcccaggatctggccgaggaggtggggaacaagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctggtcccagg

SEQ ID NO: 25706 - DNA, 1452 bp, Homo sapiens
cagctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggatggggcaggaccagaccaagcagcagatcgagaaggggctccagctgtaccagtccaaccagacagagaaggcattgcaggtgtggacaaaggtgctggagaagagctcggacctcatggggcgcttccgcgtgctgggctgcctggtcacagcccactcggagatgggccgctacaaggagatgctgaagttcgctgtggtccagatcgacacggcccgggagctggaggatgccgacttcctcctggagagctacctgaacctggcacgcagcaacgagaagctgtgcgagtttcacaagaccatctcctactgcaagacctgccttgggctgcctggtaccagggcaggtgcccagctcggaggccaggtcagcctgagcatgggcaatgccttcctgggcctcagcgtcttccagaaggccctggagagcttcgagaaggccctgcgctatgcccacaacaatgatgacgccatgctcgagtgccgcgtgtgctgcagcctgggcagcttctatgcccaggtcaaggactacgagaaagccctgttcttcccctgcaaggcggcagagcttgtcaacaactatggcaaaggctggagcctgaagtaccgggccatgagccagtaccacatggccgtggcctatcgcctgctgggccgcctgggcagtgccatggagtgttgtgaggagtctatgaagatcgcgctgcagcacggggaccggccactgcaggcgctctgcctgctctgcttcgctgacatccaccggagccgtggggacctggagctgagccagctcaagctgcactgtctgagcgagagcatttaccgcagcaaagggctgcagcgggaactgcgggcgcacgttgtgaggttccacgagtgcgtggaggagacggagctctactgcggcctgtgcggcgagtccataggcgagaagaacagccggctgcaggccctaccttgctcccacatcttccacctcaggtgcctgcagaacaacgggacccggagctgtcccaactgccgccgctcatccatgaagcctggctttgtatgactcctggcagcaggcgtgggcttcctcctcgccactcctgctctttctccactgcacgccagaggcccatttactcctggggcagctgccaggtcgtcctcaccatagccaaggccttggggcctgcccagggctgctcccctgggcccagctcccctccctgcctctttgtactttgctctttatagaaaaataaactgtttgtacctgg

SEQ ID NO: 25707 - DNA, 1930 bp, Homo sapiens
accccaggggcgggactgtagaggcgcctataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaagctggcagattttggcctgtccacatttcagggaggctcacagtcagggacagggtccggggagccagggggcaccctgggctacttggccccagaactgtttgttaacgtaaaccggaaggcctccacagccagtgacgtctacagcttcgggatcctaatgtgggcagtgcttgctggaagagaagttgagttgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccaggaatgcctaccaaaaactgatgaagtcttccagatggtggagaacaatatgaatgctgctgtctccacggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcagggggctgagagacaaggcatgaactggtcctgcaggaccccggagccaaatccagtaacagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctagtca

SEQ ID NO: 25708 - DNA, 2054 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggcactgcactacgctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtccgcggagacggggcacacgagcactgccaggctgctcctgcatcggggcgctggcaaggaggccatga

SEQ ID NO: 25709 - DNA, 3889 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctacttttttgaagctg

SEQ ID NO: 25710 - DNA, 4017 bp, Homo sapiens
gtaacagggcggagcgcgcacctgggcacctgggcagccgccgcggcgctggctagacgtgcgcgatggagggcgacggcgggaccccatgggccctggcgctgctgcgcaccttcgacgcgggcgagttcacgggctgggagaaggtgggctcgggcggcttcgggcaggtgtacaaggtgcgccatgtccactggaagacctggctggccatcaagtgctcgcccagcctgcacgtcgacgacagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaaggaaacgggctgaatggggagctcatccgccaggtgctggcagctctgctccctgtgactggcaggtggcgctcccccggggaaggcttccgccttgagtctgaagtcatcatccgagtgacatgtcccctttcttccccacaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatgactaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcgcccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcc

SEQ ID NO: 25711 - DNA, 2449 bp, Homo sapiens
aaattcggtgggtcggttgtcgtctgtgcataatttgagagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctg

SEQ ID NO: 25712 - DNA, 2601 bp, Homo sapiens
gttgatccgtccgcccagcgcttcctcgccgcacactctcgttttagctgacttaatttcgagaccgacccgctagggaagggccttgcattcaagttctgtggccgtgccatggggccctcctgcaccccagtttcccagtccaaaagtcagaatggaacctgcctgtacctacctagcaggagtgttcaagggagcgcatggagcttttggaagaagccaagaagatggagatggccaagtttcgctacatcctgcctgtgtatggcatctgccgcgaacctgtcggcctggtcatggagtacatggagacgggctccctggaaaagctgctggcttcggagccattgccatgggatctccggttccgaatcatccacgagacggcggtgggcatgaacttcctgcactgcatggccccgccactcctgcacctggacctcaagcccgcgaacatcctgctggatgcccactaccacgtcaagatttctgattttggtctggccaagtgcaacgggctgtcccactcgcatgacctcagcatggatggcctgtttggcacaatcgcctacctccctccagagcgcatcagggagaagagccggctcttcgacaccaagcacgatgtatacagctttgcgatcgtcatctggggcgtgctcacacagaagaagccgtttgcagatgagaagaacatcctgcacatcatggtgaaggtggtgaagggccaccgccccgagctgccgcccgtgtgcagagcccggccgcgcgcctgcagccacctgatacgcctcatgcagcggtgctggcagggggatccgcgagttaggcccaccttccaagaaattacttctgaaaccgaggacctgtgtgaaaagcctgatgacgaagtgaaagaaactgctcatgatctggacgtgaaaagccccccggagcccaggagcgaggtggtgcctgcgaggctcaagcgggcctctgcccccaccttcgataacgactacagcctctccgagctgctctcacagctggactctggagtttcccaggctgtcgagggccccgaggagctcagccgcagctcctctgagtccaagctgccatcgtccggcagtgggaagaggctctcgggggtgtcctcggtggactccgccttctcttccagaggatcactgtcgctgtcctttgagcgggaaccttcaaccagcgatctgggcaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcgcggaagatcagtgtcaacgccaaggatgaggaccagtggacagccctccactttgcagcccagaacggggacgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccatgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacgctcctgcggcgaagcaagacctagctggctgcctgcggagaccgggggtccacgtggggctcttgtcctgtcctgtgttcctcgtggggatggaacgatcctgcgtggggccctgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctg

SEQ ID NO: 25713 - DNA, 6564 bp, Homo sapiens
gagagcagagaacacactttgccttctctttggtattgagtaatatcaaccaaattgcagacatctcaacactttggccaggcagcctgctgagcaaggtacctcagccagcatggcagcctctttcccacccaccttgggactcagttctgccccagatgaaattcagcacccacatattaaattttcagaatggaaatttaagctgttccgggtgagatcctttgaaaagacacctgaagaagctcaaaaggaaaagaaggattcctttgaggggaaaccctctctggagcaatctccagcagtcctggacaaggctgatggtcagaagccagtcccaactcagccattgttaaaagcccaccctaagttttcaaagaaatttcacgacaacgagaaagcaagaggcaaagcgatccatcaagccaaccttcgacatctctgccgcatctgtgggaattcttttagagctgatgagcacaacaggagatatccagtccatggtcctgtggatggtaaaaccctaggccttttacgaaagaaggaaaagagagctacttcctggccggacctcattgccaaggttttccggatcgatgtgaaggcagatgttgactcgatccaccccactgagttctgccataactgctggagcatcatgcacaggaagtttagcagtgccccatgtgaggtttacttcccgaggaacgtgaccatggagtggcacccccacacaccatcctgtgacatctgcaacactgcccgtcggggactcaagaggaagagtcttcagccaaacttgcagctcagcaaaaaactcaaaactgtgcttgaccaagcaagacaagcccgtcagcacaagagaagagctcaggcaaggatcagcagcaaggatgtcatgaagaagatcgccaactgcagtaagatacatcttagtaccaagctccttgcagtggacttcccagagcactttgtgaaatccatctcctgccagatctgtgaacacattctggctgaccctgtggagaccaactgtaagcatgtcttttgccgggtctgcattctcagatgcctcaaagtcatgggcagctattgtccctcttgccgatatccatgcttccctactgacctggagagtccagtgaagtcctttctgagcgtcttgaattccctgatggtgaaatgtccagcaaaagagtgcaatgaggaggtcagtttggaaaaatataatcaccacatctcaagtcacaaggaatcaaaagagatttttgtgcacattaataaagggggccggccccgccaacatcttctgtcgctgactcggagagctcagaagcaccggctgagggagctcaagctgcaagtcaaagcctttgctgacaaagaagaaggtggagatgtgaagtccgtgtgcatgaccttgttcctgctggctctgagggcgaggaatgagcacaggcaagctgatgagctggaggccatcatgcagggaaagggctctggcctgcagccagctgtttgcttggccatccgtgtcaacaccttcctcagctgcagtcagtaccacaagatgtacaggactgtgaaagccatcacagggagacagatttttcagcctttgcatgcccttcggaatgctgagaaggtacttctgccaggctaccaccactttgagtggcagccacctctgaagaatgtgtcttccagcactgatgttggcattattgatgggctgtctggactatcatcctctgtggatgattacccagtggacaccattgcaaagaggttccgctatgattcagctttggtgtctgctttgatggacatggaagaagacatcttggaaggcatgagatcccaagaccttgatgattacctgaatggccccttcactgtggtggtgaaggagtcttgtgatggaatgggagacgtgagtgagaagcatgggagtgggcctgtagttccagaaaaggcagtccgtttttcattcacaatcatgaaaattactattgcccacagctctcagaatgtgaaagtatttgaagaagccaaacctaactctgaactgtgttgcaagccattgtgccttatgctggcagatgagtctgaccacgagacgctgactgccatcctgagtcctctcattgctgagagggaggccatgaagagcagtgaattaatgcttgagctgggaggcattctccggactttcaagttcatcttcaggggcaccggctatgatgaaaaacttgtgcgggaagtggaaggcctcgaggcttctggctcagtctacatttgtactctttgtgatgccacccgtctggaagcctctcaaaatcttgtcttccactctataaccagaagccatgctgagaacctggaacgttatgaggtctggcgttccaacccttaccatgagtctgtggaagaactgcgggatcgggtgaaaggggtctcagctaaacctttcattgagacagtcccttccatagatgcactccactgtgacattggcaatgcagctgagttctacaagatcttccagctagagataggggaagtgtataagaatcccaatgcttccaaagaggaaaggaaaaggtggcaggccacactggacaagcatctccggaagaagatgaacctcaaaccaatcatgaggatgaatggcaactttgccaggaagctcatgaccaaagagactgtggatgcagtttgtgagttaattccttccgaggagaggcacgaggctctgagggagctgatggatctttacctgaagatgaaaccagtatggcgatcatcatgccctgctaaagagtgcccagaatccctctgccagtacagtttcaattcacagcgttttgctgagctcctttctacgaagttcaagtataggtatgagggaaaaatcaccaattattttcacaaaaccctggcccatgttcctgaaattattgagagggatggctccattggggcatgggcaagtgagggaaatgagtctggtaacaaactgtttaggcgcttccggaaaatgaatgccaggcagtccaaatgctatgagatggaagatgtcctgaaacaccactggttgtacacctccaaatacctccagaagtttatgaatgctcataatgcattaaaaacctctgggtttaccatgaaccctcaggcaagcttaggggacccattaggcatagaggactctctggaaagccaagattcaatggaattttaagtagggcaaccacttatgagttggtttttgcaattgagtttccctctgggttgcattgagggcttctcctagcaccctttactgctgtgtatggggcttcaccatccaagaggtggtaggttggagtaagatgctacagatgctctcaagtcaggaatagaaactgatgagctgattgcttgaggcttttagtgagttccgaaaagcaacaggaaaaatcagttatctgaaagctcagtaactcagaacaggagtaactgcaggggaccagagatgagcaaagatctgtgtgtgttggggagctgtcatgtaaatcaaagccaaggttgtcaaagaacagccagtgaggccaggaaagaaattggtcttgtggttttcatttttttcccccttgattgattatattttgtattgagatatgataagtgccttctatttcatttttgaataattcttcatttttataattttacatatcttggcttgctatataagattcaaaagagctttttaaatttttctaataatatcttacatttgtacagcatgatgacctttacaaagtgctctcaatgcatttacccattcgttatataaatatgttacatcaggacaactttgagaaaatcagtccttttttatgtttaaattatgtatctattgtaaccttcagagtttaggaggtcatctgctgtcatggatttttcaataatgaatttagaatacacctgttagctacagttagttattaaatcttctgataatatatgtttacttagctatcagaagccaagtatgattctttatttttactttttcatttcaagaaatttagagtttccaaatttagagcttctgcatacagtcttaaagccacagaggcttgtaaaaatataggttagcttgatgtctaaaaatatatttcatgtcttactgaaacattttgccagactttctccaaatgaaacctgaatcaatttttctaaatctaggtttcatagagtcctctcctctgcaatgtgttattctttctataatgatcagtttactttcagtggattcagaattgtgtagcaggataaccttgtatttttccatccgctaagtttagatggagtccaaacgcagtacagcagaagagttaacatttacacagtgctttttaccactgtggaatgttttcacactcatttttccttacaacaattctgaggagtaggtgttgttattatctccatttgatgggggtttaaatgatttgctcaaagtcatttaggggtaataaatacttggcttggaaatttaacacagtccttttgtctccaaagcccttcttctttccaccacaaattaatcactatgtttataaggtagtatcagaatttttttaggattcacaactaatcactatagcacatgaccttgggattacatttttatggggcaggggtaagcaagtttttaaatcatttgtgtgctctggctcttttgatagaagaaagcaacacaaaagctccaaagggccccctaaccctcttgtggctccagttatttggaaactatgatctgcatccttaggaatctgggatttgccagttgctggcaatgtagagcaggcatggaattttatatgctagtgagtcataatgatatgttagtgttaattagttttttcttcctttgattttattggccataattgctactcttcatacacagtatatcaaagagcttgataatttagttgtcaaaagtgcatcggcgacattatctttaattgtatgtatttggtgcttcttcagggattgaactcagtatctttcattaaaaaacacagcagttttccttgctttttatatgcagaatatcaaagtcatttctaatttagttgtcaaaaacatatacatattttaacattagtttttttgaaaactcttggttttgtttttttggaaatgagtgggccactaagccacactttcccttcatcctgcttaatccttccagcatgtctctgcactaataaacagctaaattcacataatcatcctatttactgaagcatggtcatgctggtttatagattttttacccatttctactctttttctctattggtggcactgtaaatactttccagtattaaattatccttttctaacactgtaggaactattttgaatgcatgtgactaagagcatgatttatagcacaacctttccaataatcccttaatcagatcacattttgataaaccctgggaacatctggctgcaggaatttcaatatgtagaaacgctgcctatggttttttgcccttactgttgagactgcaatatcctagaccctagttttatactagagttttatttttagcaatgcctattgcaagtgcaattatatactccagggaaattcaccacactgaatcgagcatttgtgtgtgtatgtgtgaagtatatactgggacttcagaagtgcaatgtatttttctcctgtgaaacctgaatctacaagttttcctgccaagccactcaggtgcattgcagggaccagtgataatggctgatgaaaattgatgattggtcagtgaggtcaaaaggagccttgggattaataaacatgcactgagaagcaagaggaggagaaaaagatgtctttttcttccaggtgaactggaatttagttttgcctcagatttttttcccacaagatacagaagaagataaagatttttttggttgagagtgtgggtcttgcattacatcaaacagagttcaaattccacacagataagaggcaggatatataagcgccagtggtagttgggaggaataaaccattatttggatgcaggtggtttttgattgcaaatatgtgtgtgtcttcagtgattgtatgacagatgatgtattcttttgatgttaaaagattttaagtaagagtagatacattgtacccattttacattttcttattttaactacagtaatctacataaatatacctcagaaatcatttttggtgattattttttgttttgtagaattgcacttcagtttattttcttacaaataaccttacattttgtttaatggcttccaagagccttttttttttttgtatttcagagaaaattcaggtaccaggatgcaatggatttatttgattcaggggacctgtgtttccatgtcaaatgttttcaaataaaatgaaatatgagtttcaatactttttatattttaatatttccattcattaatattatggttattgtcagcaattttatgtttgaatatttgaaataaaagtttaagatt

SEQ ID NO: 25714 - DNA, 2388 bp, Homo sapiens
actctctttacagtcagccttctgcttgccacagtcatagtgggcagtcagtgaatcttccccaagtgctgacaattaatacctggtttagcggcaaagattcagagaggcgtgagcagcccctctggccttcagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaagtatgggtgttctctttggaggacgctcatacatgccttctacccacagaaccacagaaaaatggaatagtgtagctgactgcctgccctgtgttttcctggtggattttgaatttgggtgtgctacatcatacattcttccagaacttcaggatgggctatcttttcatgtctctattgccaaaaatgacaccatctatattttaggaggacattcacttgccaataatatccggcctgccaacctgtacagaataagggttgatcttcccctgggtagcccagctgtgaattgcacagtcttgccaggaggaatctctgtctccagtgcaatcctgactcaaactaacaatgatgaatttgttattgttggtggctatcagcttgaaaatcaaaaaagaatgatctgcaacatcatctctttagaggacaacaagatagaaattcgtgagatggagaccccagattggaccccagacattaagcacagcaagatatggtttggaagcaacatgggaaatggaactgtttttcttggcataccaggagacaataaacaagttgtttcagaaggattctatttctatatgttgaaatgtgctgaagatgatactaatgaagagcagacaacattcacaaacagtcaaacatcaacagaagatccaggggattccactccctttgaagactctgaagaattttgtttcagtgcagaagcaaatagttttgatggtgatgatgaatttgacacctataatgaagatgatgaagaagatgagtctgagacaggctactggattacatgctgccctacttgtgatgtggatatcaacacttgggtaccattctattcaactgagctcaacaaacccgccatgatctactgctctcatggggatgggcactgggtccatgctcagtgcatggatctggcagaacgcacactcatccatctgtcagcaggaagcaacaagtattactgcaatgagcatgtggagatagcaagagctctacacactccccaaagagtcctacccttaaaaaagcctccaatgaaatccctccgtaaaaaaggttctggaaaaatcttgactcctgccaagaaatcctttcttagaaggttgtttgattagttttgcaaaagcctttcagattcaggtgtatggaatttttgaatctatttttaaaatcataacattgattttaaaaatacatttttgtttatttaaaatgcctatgttttcttttagttacatgaattaagggccagaaaaaagtgtttataatgcaatgataaataaagtcattctagaccctatacattttgaaaatattttacccaaatactcaatttactaatttattcttcactgaggatttctgatctgattttttattcaacaaaccttaaacacccagaagcagtaataatcatcgaggtatgtttatatttattatataagtcttggtaacaaataacctataaagtgtttatgacaaatttagccaataaagaaattaacacccaaaagaattaaattgattattttgtgcaacataacaattcggcagttggccaaaacttaaaagcaagatctactacatcccacattagtgttctttatataccttcaagcaaccctttggattatgcccatgaacaagttagtttctcatagctttacagatgtagatataaatataaatatatgtatacatatagatagataatgttctccactgacacaaaagaagaaataaataatctacatcaa

SEQ ID NO: 25715 - DNA, 569 bp, Homo sapiens
actctctttacagtcagccttctgcttgccacagtcatagtgggcagtcagtgaatcttccccaagtgctgacaattaatacctggtttagcggcaaagattcagagaggcgtgagcagcccctctggccttcagggattcaaagatccatctttcggttctgtaagacagtcacggcttttgtaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcc

SEQ ID NO: 25716 - DNA, 572 bp, Homo sapiens
aaaagtccccaggagaggctccagcaataccagggtagcggtttgcccgacaccgctccgggcgctgcagccttccggcaacccggacgttggacaaaaatctacgtaccatcagaaactatgtctctgcagatggtaacagtcagtaataacatagccttaattcagccaggcttctcactgatgaattttgatggacaagttttcttctttggacaaaaaggctggcccaaaagatcctgccccactggagttttccatctggatgtaaagcataaccatgtcaaactgaagcctacaattttctctaaggattcctgctacctccctcctcttcgctacccagccacttgcacattcaaaggcagcttggagtctgaaaagcatcaatacatcatccatggagggaaaacaccaaacaatgaggtttcagataagatttatgtcatgtctattgtttgcaagaacaacaaaaaggttacttttcgctgcacagagaaagacttggtaggagatgttcctgaagccagatatggtcattccattaatgtggtgtacagccgagggaaaag

SEQ ID NO: 25717 - DNA, 554 bp, Homo sapiens
actctctttacagtcagccttctgcttgccacagtcatagtgggcagtcagtgaatcttccccaagtgctgacaattaatacctggtttagcggcaaagattcagagaggcgtgagcagcccctctggccttcagaatgaagatgaaaagaagatgtgtttaggaaccttctctgcttccctaaaagaaccctaaaaacaggagtaaaaacagtgaagaaaacaaaggaccttcaaagtgcactcgttaaaacctaataactgtatttctattactaaatgtagaagtggtaaacatctttaacaggcaatgtctcccctgcactctagggattcaaagatccatctttcggttctgtaagacagtcacggcttttgtaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactatg

SEQ ID NO: 25718 - DNA, 2388 bp, Homo sapiens
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaatt

SEQ ID NO: 25719 - DNA, 5549 bp, Homo sapiens
tgtttttaagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgt

SEQ ID NO: 25720 - DNA, 1682 bp, Homo sapiens
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaa

SEQ ID NO: 25721 - DNA, 1752 bp, Homo sapiens
atgctccatcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaa

SEQ ID NO: 25722 - DNA, 2499 bp, Homo sapiens
agggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaatt

SEQ ID NO: 25723 - DNA, 1697 bp, Homo sapiens
acccattgaggaggtgtttcatctaggcctgtgaaacgcagcccattttcccaggacccctcctcccttctcctcggccccgcctcctgacccctccattcctcgtccccgtagtaatcccctccggttttcctcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaa

SEQ ID NO: 25724 - DNA, 731 bp, Homo sapiens
tacagatacactggctgaggtgttttgaggtgcatcgaagtgttccaagctgtgacttaccttaacatgttcttgaagtaccatggcgtggattaaaagggtcttgctctgtcatccaggctagagtggactggtgcgatctcagctcactgcagcctcgacttcctggactcaatcttgcttcaaggtctttttcaagtgctgtgtcttcactgtctcagaagtttacacttcctatttcagaggaaataacaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgact

SEQ ID NO: 25725 - DNA, 758 bp, Homo sapiens
gggggccccgtgcatctttgttcctcgcggccgttgtcgccgcttcgccccgctagtgcccccggccccgggcgctttgtctttcaccgctacccgctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgtgggtcccctctcacctttctgtatggtcctggatcaccccccgaggctttgtctcccccatccacgggcttattctctcggcacccccttcctctcccgtcatcggttgatttatccacaacccacggtgtacgtctgctgaactgtctcagccccggggactccatctgctgcttctaagtgcacacaagactctacgtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagc

SEQ ID NO: 25726 - DNA, 566 bp, Homo sapiens
agtggaaggcggtgggaaggaggtgtagcgtgagactggactgcccgcattgggtacatgcgcagtgccgctcgcgcgggccgcgccaatcctgcagcgccttcaacagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaa

SEQ ID NO: 25727 - DNA, 1689 bp, Homo sapiens
agcccagtgacctgccacagcccgggcaccagatttctgccttaattgttcttccattgtctttctcctgaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacag

SEQ ID NO: 25728 - DNA, 607 bp, Homo sapiens
ttagaaggaggctcaagatgtatatatgtgtttttctgttagtgtttgagaatagtttcagatagccacaatggatattcatttggcgtgaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgac

SEQ ID NO: 25729 - DNA, 555 bp, Homo sapiens
atcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaa

SEQ ID NO: 25730 - DNA, 572 bp, Homo sapiens
gagcgggccggggcgggcgtggcgtgggtgtgccaggagctccgcggttgccgcgaagcgagctggagctgaccctcggcgtccctcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaac

SEQ ID NO: 25731 - DNA, 609 bp, Homo sapiens
ttcattctgacatttttacttcctttgttgccaggcaaagtggccaccagattgggtggaaggggctctttctacggcatttcatgactgagcctccaagaacaacctgtattgagtttctctttgagatgattggactgctctatccagcatcattgagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtg

SEQ ID NO: 25732 - DNA, 795 bp, Homo sapiens
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgact

SEQ ID NO: 25733 - DNA, 578 bp, Homo sapiens
tatatttaccaggattactatgctgaaggtattcttcaagagtttgttttttttctactggttgatctctacttttagaagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacag

SEQ ID NO: 25734 - DNA, 569 bp, Homo sapiens
gcaatctaggctgcctgaggatgattggagggtatcgtaggacggttagaaggaggctcaagattcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaaca

SEQ ID NO: 25735 - DNA, 340 bp, Homo sapiens
gagccgcctgcgcatgctccatcgcctggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatg

SEQ ID NO: 25736 - DNA, 698 bp, Homo sapiens
gtgtttgttattgtgaatccctaagggtgactgttttttcagcagggcgagttaggacggcacaaactgagagtttctgttctggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctct

SEQ ID NO: 25737 - DNA, 1054 bp, Homo sapiens
atctgtgattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcgggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtt

SEQ ID NO: 25738 - DNA, 932 bp, Homo sapiens
atctgtgattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaagga

SEQ ID NO: 25739 - DNA, 2572 bp, Homo sapiens
gagatccgagagtcggagatcggagagtcggacacaggacagtcggacaccggacagtcaaacaccggagagttagaccgggcttctcggtggggagaggctctgggataactactgttacagctttgaagggtcaagggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgt

SEQ ID NO: 25740 - DNA, 3702 bp, Homo sapiens
gtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaagggtgtgcgctttttgtttcatccttccctttcctgctgcagggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatggttttacactcgtcatttgcccattgatctctcttatggaagaccaattaatggttttaaaacaattaggaatttcagcaaccatgttaaatgcttctagttctaaggagcatgttaaatgggttcatgctgaaatggtaaataaaaactccgagttaaagctgatttatgtgactccagagaaaattgcaaaaagcaaaatgtttatgtcaagactagagaaagcctatgaagcaaggagatttactcgaattgctgtggatgaagttcactgctgtagtcagtggggacatgatttcagacctgattataaggcacttggtatcttaaagcggcagttccctaacgcatcactaattgggctgactgcaactgcaacaaatcacgttttgacggatgctcagaaaattttgtgcattgaaaagtgttttacttttacagcttcttttaataggccaaatctatattatgaggttcggcagaagccctcaaacactgaagattttattgaggatattgtaaagctcattaatgggagatacaaagggcaatcaggaatcatatattgtttttctcagaaagactctgaacaagttacggttagtttgcagaatctgggaattcatgcaggtgcttaccatgccaatttggagccagaagataagaccacagttcatagaaaatggtcagccaatgaaattcaggtagtagtggcaactgttgcatttggtatgggaattgataagccagatgtgaggtttgttatccatcattcaatgagtaaatccatggaaaattattaccaagagagtggacgtgcaggtcgagatgacatgaaagcagactgtattttgtactacggctttggagatatattcagaataagttcaatggtggtgatggaaaatgtgggacagcagaagctttatgagatggtatcatactgtcaaaacataagcaaatgtcgtcgtgtgttgatggctcaacattttgatgaagtatggaactcagaagcatgtaacaaaatgtgcgataactgctgtaaagacagtgcatttgaaagaaagaacataacagagtactgcagagatctaatcaagatcctgaagcaggcagaggaactgaatgaaaaactcactccattgaaactgattgattcttggatgggaaagggtgcagcaaaactgagagtagcaggtgttgtggctcccacacttcctcgtgaagatctggagaagattattgcacactttctaatacagcagtatcttaaagaagactacagttttacagcttatgctaccatttcgtatttgaaaataggacctaaagctaatcttctgaacaatgaggcacatgctattactatgcaagtgacaaagtccacgcagaactctttcagggctgaatcgtctcaaacttgtcattctgaacaaggtgataaaaagatggaggaaaaaaattcaggcaacttccagaagaaggctgcaaacatgcttcagcaatctggttctaagaatacaggagctaagaaaagaaaaatcgatgatgcctgatatgaatgttactaaattttctaattaaagatggtttatgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacattggaagaagaattgtcttgggccgcacataaaatatgctaacactgatgatagctgatgagcttaaaaaaaaaattgcaagaaaaatctcatgttttaagaaagtttacaaaaaatgtaaaatatttgagaataagttcatgtaattgtcttaagttttttatgcctttatatacttagctatattttttcttttgacataaccatctttttgaaagcaatattatactgacagaggttcactgagtgatactttaagttaaatatgtagatcagggatgtccaatcttttggcttccctgagccacattggaagaagaattgtcttgggccgcacataaaatatgctaacactgacgatagctgatgagcttaaaaaaaaaaaaattgcaagaaaaatctcatgttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaaaatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaactt

SEQ ID NO: 25741 - DNA, 565 bp, Homo sapiens
gattggctgaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaa

SEQ ID NO: 25742 - DNA, 578 bp, Homo sapiens
gaacggaccgacccggaagggtggatgctctcagctggctggcgggaagattttactcccgagtagcggaaagatctgctcgaggcctgggtgctttggtgtcggagatccgagagtcggagatcggagagtcggacacaggacagtcggacaccggacagtcaaacaccggagagttagaccgggcttctcggtggggagaggctctgggataactactgttacagctttgaagggtcaaggaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagct

SEQ ID NO: 25743 - DNA, 579 bp, Homo sapiens
gtagcggaaagatctgctcgaggcctgggtgctttggtgtcggagatccgagagtcggagatcggagagtcggacacaggacagtcggacaccggacagtcaaacaccggagaggcgaggccggtctgtagcggatcacttcctttcgcccacacattggcggaggagaaaccggaaagttaatcactgccctgctctgagaactcgggcctttaggggcacgttcgcctgctgaccggtcttctgatctccccattcttttccatgcaggaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattt

SEQ ID NO: 25744 - DNA, 600 bp, Homo sapiens
gagtagcggaaagatctgctcgaggcctgggtgctttggtgtcggagatccgagagtcggagatcggagagtcggacacaggacagtcggacaccggacagtcaaacaccggagagaggattggccaccaaagcctgtttattagcagctgccatttgttgaaagaaatttggattattttagaaacaaatttggaaagaaaaagaatggcgtccgtttcagctctaactgaggaactggattctataaccagtgagctacatgcagtagaaattcaaattcaagaacttacggaaaggcaacaagagcttattcagaaaaaaaaagtcctgacaaagaaaataaagcagtgtttagaggattctgatgccggggcaagcaatgaatatgattcttcacctgccgcttggaataaagaagattttccatggtctggtaaagttaaagatattctgcaaaatgtctttaaactggaaaagttcagaccacttcagcttgaaactattaacgtaacaatggctggaaaggaggtatttcttgttatgcctacaggaggtggaaagagcttatgttaccagttaccagcattatgttcagatg

SEQ ID NO: 25745 - DNA, 3683 bp, Homo sapiens
atataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacaactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggc

SEQ ID NO: 25746 - DNA, 1741 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcag

SEQ ID NO: 25747 - DNA, 3702 bp, Homo sapiens
acggatataagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtaagtgacttattttatatgtggagcaaagtgtcagtgagatcatttacttccccggcacgccctagttaagcagctgacataagacagcccgtaggctaccaagggacacctgcctgcaaaggctgttgtgtcgggcagtgtggaagtcaggaccttgctcttctctattggaggccccgggatctctcgcagtgtggggatttgctcagtattctgagtggtgtccttccctccactccaccctcttctgggatggctggccccacaagccactcagttccaagggatgtgaccagctctgagccatcggctttgtggtcatcatgtgccaccgagctgggacttctggcatcacttgagtagtcctcacccttatccaggacccacacagaagcctgtggccccacttacctcggggagtcatgtgctttgaactcacgcatctgttttacctgcatctgcaggcgatggggcaggggccacggaaagagtctgagggctgcttggtgtagtcaggttgtgtccaggcatgcggagctgtgagtgcctgcaggagagacacccaggaggagtttttacattttggtctaaaaagctcttggattcatctcatctcatggaatgatcctgtcggatgacgctgacgtgattgcttcagacttagaggtgaataaattgaggtccagagaggtcacagtcacgaagctcatggtagactgaggccactaaacacccgtctcctgattttcagtggcgtcctcatttgcatacacctgggccatcttggtttttgcaagaaaaaagcgaggaaatcagagaaactctttgggctgtgtgtttttatttccacctcctcctgttgaccagtgagtcggtggcttctggactgaagctattttcttctccaaactgctgtctctaatttggcctctgtggcaagaccacgcccagcaaaagtggtcggctgcagtgccaggaccacccttgcctgcagcctttgcgaccagagcccttttcaagcacaattaatatgggagttgctaaatttggccttcttaggcttcttgagcagagctcttatttctggtgaggaatgaaagggccaagtgttcctgttcattgtgagtcctgtttgctgaaaaaagctctggggctgtctgaggctctggaatgctctctggagggttaactctgcctgtccccagggtctgctccgcctgccaggcaagggaacaggtcctcccaagggcctctgccttcatttctcctgtcaccttccggggagctgggacttcttagtgcatcagtggcctggttgccaggggctggggtccaggcatctgtggactcaaggagtccaggtgacggtgttgcgctgcctcttgagcagcctcgtgcctgtctcctttgctacatgtgatgattctgaaatccaggcagcaggctggaataaacgctgctggtatgtctgtattggctactgttctttgaataagtgaatgtttctttattgcataactggcgtgtagcacaaagaaaaagccccttctccaccagatatttgcttcctaagaatagttctcattggaggctgaggtcgaagcagcctcccaccagcgatcccttggggcgggcacctggcagtgagggacagagctagtggggtgggctcagcagaagtgggtgcatttctgcaaaggaagctgtaggtttcttgtcagtttgttgtggggtctgaggcacatgggagtgggaccagcagaaaagatactcaggtcagttaactaatgaggcggggctgtggcagccagcggttttcctctcttctctatctgtagctactttctctgggctgcagccttgaaaaagcagtgtttgattattcataacaatgagtgtcttttagtgtcacagggaacagttattaggtttgaagcaacctccagcttgaggcctcggcatcttgagatggaagagcagccttgtgtttagacctggattgaattgggccctgttgtttcctgggatcttggggctgggggtgcccaacagcctggcatcttcttgtttctctgtgtgtttactcattcattcatttattcagctgataaatattgactgatgccagctctgtgccaggcacattggacatgggggatacactagtgggcagaaatagccccgtcccagagccggccatggtggctcatacctgttataccagcactttgggaggctgaagtgggaggatcgcttgagcctgggagttcaagaccagcctgggcaacatggcaagaccctgtctctact

SEQ ID NO: 25748 - DNA, 3440 bp, Homo sapiens
aagattgcgtgggttctgcctaaagctgaattcccagcgctttggcttctctgagttggggttgtgtataggggtcttcgaacagttccggaaccagccagcagcctttaattcttgggcggaccacggccggttctgtgttcttggctaagatgagcagccaccataccacctttccttttgaccctgagcggcgagtccggagtacgctgaagaaggtctttgggtttgactcttttaagacgcctttacaggagagtgcgaccatggctgtagtaaaaggtaacaaggacgtctttgtgtgcatgcccacaggggcaggaaaatccctatgctatcagctccctgctctgttggccaaaggcatcaccattgtagtctctcctctcattgctttgattcaggaccaagtggaccacttgctaaccctaaaggtacgagtaagttccctgaactcgaagctctctgcacaggaaaggaaggagctgcttgctgacctggagcgagaaaagccccagaccaagattctgtacatcaccccagagatggcagcttcatcctccttccagcccaccctgaactccctggtgtcccgccacctgctgtcttacttggtggtggatgaagctcattgtgtttcccaatgggggcatgactttcgtcctgactacttgcgtctgggtgccctgcgctcccgcctgggacatgccccttgtgtggctctgaccgccacagccaccccacaggtccaagaggacgtgtttgctgccctgcacctgaagaaaccagttgccatcttcaagactccctgcttccgggccaacctcttctatgatgtgcaattcaaggaactgatttctgatccctatgggaacctgaaggacttctgccttaaggctcttggacaggaggctgataaagggttatctggctgcggcattgtgtactgcaggactagagaggcttgtgaacagctggccatagagctcagctgcaggggtgtgaacgccaaggcttaccatgcagggctgaaggcctctgaaagaacgctggtgcagaacgactggatggaggagaaggtccctgtaattgttgcaaccattagttttgggatgggagtggataaagccaatgtcaggtttgtcgcccattggaatattgccaagtctatggctgggtactaccaggagtctggccgggctggcagggatgggaagccttcctggtgccgtctctattactccaggaatgaccgggaccaagtcagcttcctgatcaggaaggaagtagcaaaactccaggaaaagagaggaaacaaagcatctgataaagccactatcatggcctttgatgccctggtgaccttctgtgaagaactggggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacaactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacacag

SEQ ID NO: 25749 - DNA, 3089 bp, Homo sapiens
tctgtggccattgccactcacctgggagctcaggtgttgggggctgagcagcagtgccccagcgcggagcctccacgtgctgtcctcgtacttccttcgtgggcgccgctgctcccctgggcgcctcagcccagctcctctgctgacagccagctgctgtctctgcctggcttttttgttgttggtcgtcctggagatccaagtgtcaaattaccgtcgcgagggggagcccgaggaagccctgcttgggaacttgtcctccaacttcatgtcccggtgcctcacctctgccctgagagcgctgctcagggacaagacaagctccctctctcctcctccttcctcctcctctccctctccccgactcccacgccgtgggctgggcctgggttgggagctgaagaaagaagtcggctctctgccttcctggccaggaggaccctggggaggctccacctgagcctgtggaggggagtcctgcagcgctctcaggtctggggcacccaccctgccctcaggaaggccaccccttctgtccctctggccactccctggctggtccctccctctggcctctctcaggaacaacagtaaacagtggggagctggtggccctctcaagctgagcaggaggctttgcaaccagtccctggggaggcccttgtgccgctcagcatctgaaggcgtcttgggggagaacttggaatcctgagtgacctgggagtggcctgcgcgcccggcaaggcgcctcatgttccttgtgaggtgccgccatgccgccattgccaagtacttcggggatgcgctgcctgcctgcgccaaaggctgcgaccactgccagaaccccacggccgtgcggaggcggctggaggccttggagcgcagcagcagctggagcaagacctgcatcgggccctcccaggggaacggctttgaccccgagctgtatgagggaggccgcaagggctacggggacttcagcaggtatgacgaaggttctggaggcagcggggatgaaggcagagatgaggcccacaagcgggagtggaacctcttctatcagaagcagatgcagctgcgcaagggcaaagaccccaagatagaagaatttgtacccccagatgagaactgtcccctgaaagaggcttctagcaggaggatccccaggctgactgtgaaggcacgggagcactgcctgcggcttctggaggaggcgctgagcagcaaccgccagtcaacacgtaccgctgatgaagctgacctccgggccaaggccgtggagctggaacatgagacattccggaacgccaaggtggccaacctctacaaggccagcgtgctgaagaaggtggccgatatccacagagcctccaaggatgggcagccctatgacatgggaggcagtgccaagagctgcagtgcccaagctgagcccccggagcccaatgagtatgacattccaccagcctcccatgtgtactcgctcaaacccaagcgggtgggagctggtttccccaaaggctcctgcccgttccagacggccacggaactgatggagacaactcggatcagggagcaagccccccagcccgagcggggaggcgagcacgagcccccgagccggccctgtggcctcctggatgaggatgggagtgagcccctccctgggcccagaggggaggtccctggaggcagcgctcactatggggggccctcccctgagaagaaggcaaaaagttcctctgggggcagctcccttgccaagggccgggctagcaagaaacagcagctcctagccacagcggcccacaaggattctcagagcatcgcccgcttcttctgccgaagggtggaaagcccagctctgctggcatcagccccagaggcagaaggtgcctgcccctcctgtgagggggttcagggacccccgatggccccagagaagtacacaggggaggaagatggagccgggggacattcgcctgcccctccccagactgaggagtgcctcagggagaggccaagcacctgcccgcccagagaccagggcacccctgaagtccagcccacccctgcaaaggacacatggaagggcaagcggcctcgatcccagcaggagaacccagagagccagcctcagaagaggccacgcccctcagccaagccctccgtcgtagctgaggtcaagggcagcgtctcggccagcgaacagggcaccttgaatcccacggctcaagaccccttccagctctccgctcctggcgtctccttgaaggaggctgcaaatgttgtggtcaagtgcctcacccctttctacaaggagggcaagtttgcttccaaggagttgtttaaaggctttgcccgccacctctcacacttgctgactcagaagacctctcctggaaggagcgtgaaagaagaggcccagaacctcatcaggcacttcttccatggccgggcccggtgcgagagcgaagctgactggcatggcctgtgtggcccccagagatgaccaactgctggctgggcagggcccgcgtcctcccccagattctagcatgggtcatcctgggcctcacctgctgatgccagggccatcgtcttttctcagtccttctcctttccaaccatacttggctttggggatgaccccagacaccccctgaatccaggtcagaggtcagcccacctttctttctgcttgcaaagcctatagacccttctcagagcggtcctcatggctgggttttctgggacacatgtcgaggacagaaggtggagggtggtggagctgctgctggaagaaggggaaggaagagtggcccctccccgagttctaagtcaggatgaggcccacctgtccaaggtatcggaacctacccaggggaccctcagatcctccacccactcccccatccattacgatgccagcttccagccttgcccaggtcagagctgtggcagaggagaggcagccaggccctgttcctgctcagctcctgctcaggaaggccaggcctgacagatgtttgggagaggaataaagttgtgttgttgtggggcatgcaggcgtgcacacagcccttttc

SEQ ID NO: 25750 - DNA, 808 bp, Homo sapiens
gatataaagctcctacagctacctggcctgagaagccaactcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcaactggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccctaaataataaaaataaacatgtttccactattgtgctgtc

SEQ ID NO: 25751 - DNA, 938 bp, Homo sapiens
catccctgagatctttttataaaaaacccagtctttgctgaccagacaaagcataccagatctcaccagagagtcctaggggactacagaaggaaaaagacaagaggcagtaggatatctgtgtgtcctcccgctgaccacacttcctttagtgacccgattgcctcctcaagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctattcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatac

SEQ ID NO: 25752 - DNA, 856 bp, Homo sapiens
attcactccagtgaccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctattcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatacgta

SEQ ID NO: 25753 - DNA, 575 bp, Homo sapiens
cccagtctttgctgaccagacaaagcataccagatctcaccagagagtcctaggggactacagaaggaaaaagacaagaggcagtaggatatctgtgtgtcctcccgctgaccacacttcctttagtgacccgattgcctcctcaagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctgagc

SEQ ID NO: 25754 - DNA, 1357 bp, Homo sapiens
gttcttttcctggctagtcaaagcacaccttacgtacattctgaagccgtctcttatatgattcatttttttcactgtagataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccatgggaaggtttaccagtagaatccttgctaggttgatgtgggccatacattcctttaataaaccattgtgtacataagag

SEQ ID NO: 25755 - DNA, 1517 bp, Homo sapiens
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagaatgcccatatccgtcttacctgtgaggaagcttgccttgggcgccctctgctggccctcctgaagctaacaggggcgagtgctcggtggtttacaaattgcctccatgcagactatgaaactgttcagcctgctatagttagatctctggcactggcccaggaggtcttgcagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagaggcagcagtggcagtggattgatggggccatgtatctgtacagatcctggtctggcaagtccatgggtgggaacaagcactgtgctgagatgagctccaataacaactttttaacttggagcagcaacgaatgcaacaagcgccaacacttcctgtgcaagtaccgaccatagagcaagaatcaagattctgctaactcctgcacagccccgtcctcttcctttctgctagcctggctaaatctgctcattatttcagaggggaaacctagcaaactaagagtgataagggccctactacactggcttttttaggcttagagacagaaactttagcattggcccagtagtggcttctagctctaaatgtttgccccgccatccctttccacagtatccttcttccctcctcccctgtctctggctgtctcgagcagtctagaagagtgcatctccagcctatgaaacagctgggtctttggccataagaagtaaagatttgaagacagaaggaagaaactcaggagtaagcttctagaccccttcagcttctacacccttctgccctctctccattgcctgcaccccaccccagccactcaactcctgcttgtttttcctttggccatgggaaggtttaccagtagaatccttgctaggttgatgtgggccatacattcctttaataaaccattgtgtacataagaggttgctgtgttccagttcagtaatggtgaatgtggaaaagtgaaataagaccaagaaatacaccca

SEQ ID NO: 25756 - DNA, 2327 bp, Homo sapiens
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgaggtaagaaacttgctgcctgcttggcctggcctttctagagcaaaggaccagccagagccccagatctcatttgattcaggatcaagtgtccttcctgggcactatgaagagaagcccctttggctggtgaaatggagagaagagggttgtgtgttcaactcattcaattctgtaagcattgctgaagcaggtgctgtatgccagaccctagatgggctacaagcacatacggatacataggaaagagcccctaccctcagcaagctcactgtcagtaaaggagacagaaatacatcaatcaaaggaggaagagaagatgaggaattcacagaaaggataatggagtttctgtacaagatttaccagaaagagagtggtgtgtagacatgcctggagcagacaccttggagccgctgacagaaggtgaagcagtccaagaaaatgtggaaacttttccgctgctctacacagtccacaaacctgtccattttatttcgttgaagctttgtctgagagataaccaaatagacagtcaaagtaagttatctcagccacatatggggagtggatgctgctgaattgtgattaattgggggagccatataggtacatttggcatgatctgggcctatgcggtcttacaatccctgtataaaactagacaatgaaaaacagaaaacaaaacaaacaaacaaaaaaacaagaacgaagcacctaccacatgccagctactgaggctatgaaggtattctcccgccttagaaagcccaggattaatgcaggattgcgacatttaaacagaacatttccatacagcatgagtataaatgactttcccaagtttacactgagagtaactgacacagcaaccccagcaaagtctgagctgagtcctgaataattgtataaaaaggggagagaaacagagtgaagaaagggtttcccagactctgtcccaggaaagaaaatgagctcgtggagaggaatagactttctctatgaaaacagagggaacaaagaggaagatgtctgggaaccgaggagtaatagagacctgagtttacatcactactctgccactccctaggtacctccctttacctgtttccctactggaaagtgggataatactttttacctcatggacttgtcaggaggattcattaaaacgactcgcataaagcctatgccacatggtagatgccaattcagggtctcaagaaagaacagcccacaggattgacactgaaccttaacaaagttaacaggaccaaggtgcagagagggtgctaggacagcgaagccaaagaggacccctcaaacccaacaagagctgtgcggctccctgattcctcgccagtgttgctaccgcccttggctcttcttgcatggctggctcttgagacccctggaagctgatggaggcaacgtgagaagcacatggacatccgaccttgagcttgagaggcagaggcctgagttctagttacagccccagcagtaccagttgtgtggactgggagggaggctatcacgtacatacttcaagcctccaaacctgtttccccttctgacacaggatcttctgtggctggtatagagtgggcactcaataaatgctgtctggtcgtctggctggcatgcctcatgggcctgagaattgaatagaattacagtgatagaagcatgctggtattgtaagtggtttgtaagtgtgaggactaaattattattaaatagtaatcacatctaatcttggataaattagtaaaagcaagaatgggagcagtaaaaacctaagcaacccgaactaaaattttattgaattaattcaatttcttgtcatgtaacacaaccccagaagagaataaaataaagtttatatacatacaccca

SEQ ID NO: 25757 - DNA, 641 bp, Homo sapiens
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagatggcttccagaagcatgcggctgctcctattgctgagctgcctggccaaaacaggagtcctgggtgatatcatcatgagacccagctgtgctcctggatggttttaccacaagtccaattgctatggttacttcaggaagctgaggaactggtctgatgccgagctcgagtgtcagtcttacggaaacggagcccacctggcatctatcctgagtttaaaggaagccagcaccatagcagagtacataagtggctatcagagaagccagccgatatggattggcctgcacgacccacagaagcagccactcaactcctgcttgtttttcctttggccatgggaaggtttaccagtagaatccttgctaggttga

SEQ ID NO: 25758 - DNA, 1356 bp, Homo sapiens
acaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatg

SEQ ID NO: 25759 - DNA, 1611 bp, Homo sapiens
ccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacc

SEQ ID NO: 25760 - DNA, 2235 bp, Homo sapiens
gtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctggcaccatggctgaggaaacagctccagcagttcttgagcggcaccagggggccctgtactccctctttcctgatcaccacgtgaaaaagtactttgaccaggtggacatttccaatggtttggattggtcgctagaccacaaaatcttctattacattgacagcctgtcctactccgtggatgcctttgactatgacctgcagacaggacagatctccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacc

SEQ ID NO: 25761 - DNA, 2019 bp, Homo sapiens
gtgcccgagccaggccggcctccccgccccctccctggaaaggaaaggccccggcgacaacagagccagacccgctcatcccgatctcccagaaggcgactgacagctgactgccagaaggagatcgcgccaggagactgactgctctgtgcccacccggggacccgggcccgttcagccgggctggctggtgcgccctctgcaaagcctgcgccagggaggaggcaggctcaaccttcagattcccagggcctctctgtcgctgtcgccgtcgccgtcgcccgaggtcccagcggctctaccagattgttgtggaggcctctcacccgcacagataatttttctctgtcttctcccagttcgctggtcatggtctctggcctaaagtcccagcatagactgttcctctcctgtggagtctaacactctttgccaaactggcacggtgtcttcctgggaagcaagaaatcactgagggcctgtcagttcctgccagggtggttcgatgctgtccttttctccactccttccatggtctgcgttggaaaatgtgtgttagttcgaattcagcgagttctcattggggtgaacatagtcctaaaaatgcagttcataaaaatcaaccacacagagaagaaaaataaataaatcagtaaagcagctcagaaaaatgcaggtgtggcgggccctggcctctgcaccctcatagaggggctcaacagcatcaacagaaggtgggggagcagaaggtgccctgcagacacccagaggggccaccaatgagcaaactgccagctccctgacccgccctggggcccagggtattgacataaaggacggccttgcactatttcaacagccagttctctgagggtcacaaacaccaaggagtggaggtcagagtgtcacttttttgttttctttttgaaagatcattcgagaaacacgtcactgatctcccctgcgaccatgtcttccattaagattgagtgtgttttgccagagaactgccggtgtggtgagtctccagtatgggaggaagtgtccaactctctgctctttgtagacattcctgcaaaaaaggtttgccggtgggattcattcaccaagcaagtacagcgagtgaccatggatgccccagtcagctccgtggctcttcgccagtcgggaggctatgttgccaccattggaacaaagttctgtgctttgaactggaaagaacaatcagcagttgtcttggccacggtggataacgacaagaaaaacaatcgcttcaatgatgggaaggtggatcccgccgggaggtactttgctgccaaccgcagaagtgtttacaagctagaaaaggaagaacaaatcccagatggaatgtgtattgatgctgaggggaagctctgggtggcctgttacaatggaggaagagtgattcgtttagatcctgtgacagggaaaagacttcaaactgtgaagttgcctgttgataaaacaacttcatgctgctttggagggaagaattactctgaaatgtatgtgacctgcgcccgggatgggatggaccccgagggtcttttgaggcaacctgaagctggtggaattttcaagataactggtctgggggtcaaaggaattgctccctactcctatgcgggatgaggacaggtcttctttcctgccagagggagctctgaagacaactagagaattctgggcctgaaatttcaatctagttagaaagaaaaatgaggcaatgattttattaacagcgttaagttttaatttacaacttttaaaaggcagagcatttttaacaaggggtgacaggtggttttgataacacacttataaggctttctgtaaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacc

SEQ ID NO: 25762 - DNA, 6382 bp, Homo sapiens
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaagataaatatgttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 25763 - DNA, 6934 bp, Homo sapiens
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaagacatttgtgttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 25764 - DNA, 6622 bp, Homo sapiens
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaaaataaaattgttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 25765 - DNA, 7132 bp, Homo sapiens
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaagataaatatgttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 25766 - DNA, 6952 bp, Homo sapiens
caggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaaaataaaattgttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatggctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 25767 - DNA, 5047 bp, Homo sapiens
ctctcccgccgcgcctccgcctgcccgcccccgccggccgaggctgggctgcgggaggcggccgggcggccccgagcttcgctagggcgaccaaaacaaaggcagcatccggggctgggtggatgcaaacaaccatgaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatggctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacac

SEQ ID NO: 25768 - DNA, 5079 bp, Homo sapiens
atgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtgtgttgtcagggacatggcgaagcctgctgcctgcaaaacaccaagaaatgctgaaaaccagccccaccaaccttcaccgagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgaggacaaagtggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagacatcttgttaggcactataaaacattacctcccaagatgcctttattacagagcagttctcactggaatatttacagctcaattctgcctgcacatactaagaccaaatcagtgactagacaggacatttcccttcatcatgaatgctttaactcaacagtattgagatttactgatgaaatactggttagtgaactgcagccctttcttgacagggctaggagtgctagtaccaactgcttgagaccagatactagtttgcattcaccagaacgagaaaggggtagatggtccccctccctagataggagacgacctcctagtcccaggattcaaatccagcatgcgtctccggagaatgacaggcactccagaaagtctgaaagatctagcatccaaaaacagactaggaaaggcactgcctctgatgcagaaagggttctcccaacatgtctttctagaaggggacacgcagccccaagagcaactgatcagccagtcattaggggaaaacatcctgctcgctcaaggtcgagtgagcactctagtatcagaacactgtgttctatgcaccaccttgtccctggagggtcggcgccaccttctccgcttctgacaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatag

SEQ ID NO: 25769 - DNA, 2285 bp, Homo sapiens
cagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagaacaagaaaaatataactcttccacaaaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttg

SEQ ID NO: 25770 - DNA, 3542 bp, Homo sapiens
agtaaatgctaccagtccccacaccaccaggcccaccgaagcttgtctacagtattttatccaagcagtcctttgggtaactgcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagcaagcttagtagtggaggagcgaacaagacagatgaaaatgaaagtgcatcgatttaagcagacaacagggtctggttctagtcaagaacttgatcgcgagcaatattccaagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatc

SEQ ID NO: 25771 - DNA, 1787 bp, Homo sapiens
agttcacaggcagctcagacagatattccagccagccaccgcacaagttatttaaaccaggtcaaagcttctttggcattcagttttccccagagaacaatttaatgctgatacttaattttttcaagatagacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaa

SEQ ID NO: 25772 - DNA, 2799 bp, Homo sapiens
agaaaagcctgaagaagcacttttgcctgtgttcccaacaatcaattgtgtatactcttggtttatgctttctggtgccagttgtcattgagctgagtaagattcctcagttagggaaactgcagaggaaatgatctgttacacagggcttggcaggaccattgccagtgattgataatgggaccaaatcatttcaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacaga

SEQ ID NO: 25773 - DNA, 3065 bp, Homo sapiens
gtgttagctttaaggaccacaacgtttcatctctctggcttcaggaaggtagcagcttctgtgcattgttttaggaaatggttaattgaggagctaaaagagctttagtgtatgctacactgggagccactttagtacagcacagagcactatagattaatgctgtaatcaatgagaatctgttcactgcagagatctgttttgatgacagcagcacttatggccttgtttagtgtcactgttgtataatgttggacactgcaggcttttttggctttgatttagaatgcaaggaccacagggaattttatttaaaatgttgtattttggtggattttttaattgtgttgtgcatttgctgccattgctagctgaaatttaatgatttgatgccagtggcatttagttaaccactccgatgctgctgttatgtttgctgggtttctgcagtttctactacttcatacattgcactcaggaacaggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaaggcactccagaaagtctgaaagatctagcatccaaaaacagactaggaaaggcactgcctctgatgcagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaa

SEQ ID NO: 25774 - DNA, 3097 bp, Homo sapiens
gcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtgatttggattattactggttggatcctgccacgtggcacagccgggagacatcacctattagttcgcatcctgtaacgtggcaaccatctaaagagggggaccgattaattggacgtgttattcttaacaagagaacaaccatgcccaaagactcaggtgcattgctgggtctgaaagttgttggaggaaaaatgactgacttaggacgacttggtgctttcatcaccaaagtaaagaagggtagcctagcagatgtagttggacacctaagagcaggggatgaagttctagaatggaatggtaaacccctgccgggagctacaaatgaagaagtttacaacattattttagaatcaaaatcagaacctcaagttgaaattattgtttcaaggcctattggtgacattccccggattcctgagagctcccaccctccactggagtccagttcaagttcctttgaatctcagaagatggaaaggccttccatttctgttatttctccaacaagtcctggagctctaaaagatgccccacaagtcttaccagggcaactttctgtgaagttgtggtatgataaagtgggacaccagctgattgtaaatgttctgcaagcaacagatctacctgctagagtagatggacgtcctcgaaatccctatgtaaaaatgtattttcttccagatagaagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagatctcagcgaatcagtgatagtgacatctcagattatgaggttgatgatggtattggcgtagttcctccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggagtttagatgaaattcatccaacaagaaggtcacgttctccaaccagacaccatgatgcctcccgaagtccagttgatcatagaaccagagatgtggatagtcagtatttatcagaacaagacagtgagcttcttatgctgcccagagcaaaacgaggacgaagtgcagaatgcctacatactaccagtgaactgcagccctttcttgacagggctaggagtgctagtaccaactgcttgagaccagatactagtttgcattcaccagaacgagaaagaatgcaccgacagagaagtccaacacaatctcctccagcagacacatcgttcagcagtcgcaggggaagacagctcccacaagtgccagtgagaagcggcagtatagaacaagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaatttaatatttcctggagtgcgactgggagctgacagtcaattcagtgattttcttgatggattgggaccagcccagcttgttggccgccaaacccttgccacccctgcaatgggtgatatacaaataggaatggaggacaaaaagggccaattagaagtggaagtcattagagcacgaagcctcacacaaaagcctggttccaaatctacacctgctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgtttt

SEQ ID NO: 25775 - DNA, 3854 bp, Homo sapiens
agaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 25776 - DNA, 4161 bp, Homo sapiens
atgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaggtcaaagaagaacacaaaccacaactgacacagtggtttccctttagtggaatcactgaactggtaaataacgttcttcagccccagcaaaaacaacaaaatgaaaaggagccccagacaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatag

SEQ ID NO: 25777 - DNA, 897 bp, Homo sapiens
atgggccggcagggcttggggggtgccagcgctgcggggcgctccatgcagcgctcccagagccggagtagcctgtctgcctccttcgaggcactggccggctactttccctgcatgaactccctggaggaggaagaaggagaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttac

SEQ ID NO: 25778 - DNA, 1923 bp, Homo sapiens
acacttcagctgggaatgcccaaaaagcttactgctgtttagaattcttgctacagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagtcttcctggcctagcgtggtggctcacgcgtgtaatcccagcactttgggaggccgaggcgggcggatcacgaggtcaggagatcgagaccatcctggctaacacggtgaaaccccgtctctactaa

SEQ ID NO: 25779 - DNA, 4236 bp, Homo sapiens
atgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaggtcaaagaagaacacaaaccacaactgacacagtggtttccctttagtggaatcactgaactggtaaataacgttcttcagccccagcaaaaacaacaaaatgaaaaggagccccagacaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataagcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatag

SEQ ID NO: 25780 - DNA, 4050 bp, Homo sapiens
atgtcggctcctgtcgggccccggggccgcctggctcccatcccggcggcctctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggagaagaatcacagcaacagcaagaacagaagggtgatgcgccaacctgtggtatctgccacaaaacaaagtttgctgatggatgtggccataactgttcatattgccaaacaaagttctgtgctcgttgtggaggtcgagtgtcattacgctcaaacaaggttatgtgggtatgtaatttgtgccgaaaacaacaagaaatcctcactaaatcaggagcatggttttataatagtggatctaatacaccacagcaacctgatcaaaaggttcttcgagggctaagaaatgaggaggcacctcaggagaagaaaccaaaactacatgagcagacccagttccaaggaccctcaggtgacttatctgtacctgcagtggagaaaagtcgatctcatgggctcacaagacagcattctattaaaaatgggtcaggcgtgaagcatcacattgccagtgacatagcttcagacaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaagccaaagccttagtagaagaacaacgccttttgttcctagggttcagataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatag

SEQ ID NO: 25781 - DNA, 8002 bp, Homo sapiens
acagtcaggagaaagccgaaagctgcacgggtactgaatcttctacgactgaattagaagaataatgactgtacaattaactatcaacctctgttcatttaagcacagtttttacagagctcaggagaaatatggaacttgattggcgtgtttttatttgatggtgtcagcaaatagatgattttaaagacaggtggtagggaaaaataagagaaggggaaaaaaaaagaaagaaaatgcaatttgagacattgcgccaggtctgcaattctgttttatctcattttcatggggttttttcatccccaccaaatatcttacaaaatgagctttttggacaaacactgaacaatgcaaggaaaagaagcccatctgtgtccagagatcagaatagaagatacgaccaaagggaagaaagagaggaatattcacagtatgctacttcggataccgcaatgcctagatctccatcagattatgctgataggcgatctcaacatgaacctcagttttatgaagactctgatcatttaagttatagggactccaacaggagaagtcataggcattccaaagaatatattgtagatgatgaggatgtggaaagcagagatgaatacgaaaggcaaaggagagaggaagagtaccagtcacgctaccgaagtgatccgaatttggcccgttatccagtaaagccacaaccctatgaagaacaaatgcggatccatgctgaagtgtcccgagcacggcatgagagaaggcatagtgatgtttctttggcaaatgctgatctggaagattccaggatttctatgctaaggatggatcgaccatcaaggcaaagatctatatcagaacgtagagctgccatggaaaatcagcgatcttattcaatggaaagaactcgagaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggagacatggattacaactggttggatcatacgtcttggcatagcagtgaggcatccccaatgtctttgcaccctgtaacctggcaaccatctaaagatggagatcgtttaattggtcgcattttattaaataagcgtctaaaagatggaagtgtacctcgagattcaggagcaatgcttggcttgaaggttgtaggaggaaagatgactgaatcaggtcggctttgtgcatttattactaaagtaaaaaaaggaagtttagctgatactgtaggacatcttagaccaggtgatgaagtattagaatggaatggaagactactgcaaggagccacatttgaggaagtgtacaacatcattctagaatccaaacctgaaccacaagtagaacttgtagtttcaaggcctattggagatataccgcgaatacctgatagcacacatgcacaactggagtccagttctagctcctttgaatctcaaaaaatggatcgtccttctatttctgttacctctcccatgagtcctggaatgttgagggatgtcccacagttcttatcaggacaactttcaataaaactatggtttgacaaggttggtcaccaattaatagttacaattttgggagcaaaagatctcccttccagggaagatgggaggccaaggaatccttatgttaaaatttactttcttccagacagaagtgataaaaacaagagaagaactaaaacagtaaagaaaacattggaacccaaatggaaccaaacattcatttattctccagtccaccgaagagaatttcgggaacgaatgctagagattaccctttgggatcaagctcgtgttcgagaggaagaaagtgaattcttaggcgagattttaattgaattagaaacagcattattagatgatgagccacattggtacaaacttcagacgcatgatgtctcttcattgccacttccccacccttctccatatatgccacgaagacagctccatggagagagcccaacacggaggttgcaaaggtcaaagagaataagtgatagtgaagtctctgactatgactgtgatgatggaattggtgtagtatcagattatcgacatgatggtcgagatcttcaaagctcaacattatcagtgccagaacaagtaatgtcatcaaaccactgttcaccatcagggtctcctcatcgagtagatgttataggaaggactagatcatggtcacccagtgtccctcctccacaaagtcggaatgtggaacaggggcttcgagggacccgcactatgaccggacattataatacaattagccgaatggacagacatcgtgtcatggatgaccattattctccagatagagacagtcattttcttactctacctcgctccagatacagtcagaccattgaccatcatcacagggatggcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtctcatcctcgtactgggtctgtccagacaagcccatcaagtactccagtcgcaggacgaaggggccgacagcttccacagcttccaccaaagggaacgttggatagaaaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaatctgattttccctggtgttcgcttggcctctgatagccagttcagtgatttcctggatggccttggccctgctcagctagtgggacgccagactctggcaacacctgcaatgggtgacattcaggtaggaatgatggacaaaaagggacagctggaggtagaaatcatccgggcccgtggccttgttgtaaaaccaggttccaagacactgccagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacagatcatcgtctggggagattatggccgcatggatcacaaatcttttatgggagtggcccagatacttttagatgaactagagctatccaatatggtgatcggatggttcaaacttttcccaccttcctccctagtagatccaaccttggcccctctgacaagaagagcttcccaatcatctctggaaagttcaactggaccttcttactctcgttcatagcagctgtaaaaaaattgttgtcacagcaaccagcgttacaaaaaaaaaaaaaaaaatcacaggttgcaaaccctggtaacactgcatgcttaatgttgtgtcttctgagcctgtttctagggatacaaagcaatcctgtgttctcagaggaagttgcacacattgtgccctaaagaaggccctcaggtgaaagagcagagctgtgaagaactatcagatttggaattcaatgacactcgagttctggtccaatctgaagccatggattaatctcaaagaatcagtcagtttcatgcaacagaagcccttttcaatggcacctttatatttttatcattcctttttcttcatttatctaaccccaaagccctgatatgccacagaaatggagctatacagccatgaagcggtgttacaggtgaggagtgtaatcctaggaagcatcaggtgaaaagcaggagaccaaagaagtggtcaggaacaatcatcagccctcctctgggcgggaatcagagcagtcagtccagcaggaagagtggcagactttgtagctccatgggcacgtcaattactaatgctaagatgtgttggactctgaaaaacaaaattctgtggctacactgtactgaatgaaattaaagaaactttttttgcatggacacagattagctgaatacttaaattattttcttggggctgcaacttgcaaaaaaaaaaaaaagaataaaaatcagccattttcaacaatttatattatttttaaaaataaatttcactagtgcatggttttaaaaaggagagagaatgcaacagggtgatacaaagatacaccatgtttattctttaatcatagtctgtgttttggcagacattacaaatggaaatactttctagaagatacttaaaattctctttatgtgacaaataagtataatatattcaatttatttccatgttaaatatacaaatcttatgaagttcaatatgtgcaaatttttcacatctttctccttctctcactttacctcttctccctcttttaaacttttctttctccctgccagagtgaaccttatactaaaaaattacaagttttgatctgatcctctctcataccccatgtttgattcagagctgtagatgcctctgaatttgcgaatttctcaagggaaaattaactttaagagctttctttatttcaagcatgttgaaaaggattttgcaacatgacttgggagtacattaaagtaagtcagcatgtatttgacgaagaagatatttgaacttttgcagtttattgtacagtgcatggtaattttttcacctttaaaattcagtttacaggaaaattctaaaatcatgttgccattgtgatgtccaataaatttgtttttagcaccagcattattcatacaggggttaaagtattatttgtagaaggtcttaggttttgtttgttttttaatcatttaaagcaatttctttagccagtttccatttactatgtgaatagaagcactgctaaaaattgggaaccctgaaacacagggctgtttattaattcatttttctgtagtaaaattcaatttttcacaaattatatttctaaagaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttctttacaggcgtctgcagtgctttctctgacttttctccccacacagccctgagcctgctgcagctcattccctgaactcatgtgtcatttaaagaatgaaatcaccgtctcctacttctcgataacataagtggactgctggtcttagcagcggccctcagtagagcatttctttaaaacgccaaaggatttctgctcacactatgaaaaggtgctgttttttaaaaggttgttattttggattgagtttctttctgattaaatgactcagcaactcacagattttttgagtgaaatttttaatttagtcatggccttcactgacagcatagtcacaaatactcaggcacaggctctgctagcccctgggtgaagatggcgaaggcataactggctttatgcagcatatgtgtttctgctaaagtgtcagttttgctttgtggggagtggagggtgtgttttcgggatggggagacgtggtaacctgacatgtaacaacctgtccggagactagcttctacgtgtggatatgaatgggtgagaggatttctccatatccttctggggcgattcctcaactgggagaaggaaaccctgcagagttctcatgggagtctgcttcaggtttgaaatttaagagctagtttggattcatgtttagtaatcgaactgaaatctaagtctagctgtctctctattcttggaaacaaccatttcctccatttccaaagactcaactcgagtccaattccccctatctgtcccatatatttttcctttatcccatatataccccctactctagtgaattgtttctttgttgttcattcctgttctttgttgttcatatacattcctgtatatgaacaacattttcctttatcccatatataccccctactctagtgaattgtttctttgttgttcattcctgtttctttgttgttcatatacattcctgttataaaaattcccttccctttcttatgtgccctctcctgaaaagcccttctacttttctcaataatgatccatgcgagtcccttcttgcaactcccagctcacgaatgagctctttcggcaactcctgactaaaccctaacaacatggctgccattgatgccaacaccttcactttcccagggaccccagatgccaaggctccataggcaacaataaaggatatgatggtcctgtagtgggtatgatagaattaggcaagagatcaccaaagctgtctgcctactactgatgtaaaccttgacattctgtgcacgtaaaaatcatgtgctcaatgtgtttgtctcaactccctcagctcgtgatgccctcagggttctgtgggcatttatgcactgaagaaacaggagttcacacatccacctctggactgtgaaatgtgtattgagaaatactttgcaagagagaatttttttaagtgaacaaacaacaagtctgtgccacacacatcttccatatgccctgactcaggtcacttaatctccaggatttcatttcctcacctggaaaatatggagtttgaggtagattctcatctatcattaaatcaacactttaactaaaacgtaagctccttcagggcagagaccgtatcttcagtatcaaaaacaatgtttgacacatagctgctcaataaacatctgtccaatgaa

SEQ ID NO: 25782 - DNA, 1408 bp, Homo sapiens
gcctcggcctgtggaggccccctccctgtctggaccccggccccacctccggaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaagga

SEQ ID NO: 25783 - DNA, 7235 bp, Homo sapiens
acggtggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggt

SEQ ID NO: 25784 - DNA, 5203 bp, Homo sapiens
caagctgcccaagccgcccgccgccgccgccgccgccgcggccgaggcgcccggcgccggcgcgggcatggagcgctcgcagagccgcctcagtctgtccgcctccttcgaggcgctcgccatctacttcccgtgcatgaactccttcgacgacgaggacgcaggggacagccggaggctgaagggggccatccagaggagcacggagacgggcctggcagtggagatgcccagccggacactgcgccaggccagccacgagtccattgaggacagcatgaacagctatggctcagagggcaaccttaactatggaggagtttgcctggcgtcggacgcccagttcagtgacttcctgggaagcatggggccggcacagtttgtgggccgccagaccctggccaccacacccatgggggatgtggagatcggtctgcaggagcggaacggtcagttggaggtggacattatccaggctcggggactgacagccaagccaggctccaagacactgccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgacttggccggttcttgacctggtggatgtggctgcagtccagagaaaggaaagattgaggtggcagagcagaccactctcccttcccaaactgtccaacttctccccctttttgcctcctcggaagctcgctgcccagagccatgtccagaacccagccggccatctccatggtgccaattaccagcaagtgtctttcctgcggcaccgggttcaggcagctactcctgccccagagatgaaggggcagctttgcaaggatccggagccagctcccaggggcccagagccccccacttgaagaggagcttgagcttccctctgcctgcccgtggaaggagctttgccgcagcctgtccgagtccatccgtccgtcccctcctgcctgcccctcttctggtggctctaggaattggggttcagcagggaccaaaggaaaggaggaggtgccgggggcctggcacagacccctaggtgcctcgctccatgggattgcaacaagctagtttaggaaccgctggcggactagaaagaatgttgtcgtctgtgttccggtggaggagctgtggaacctgagtttccagaaccccaaccctagagagcatttgggggtgctgtattggagggggaggctaaggaaagttgggattgggactggtggtgccaagataagggtttctcaaattggagaacccctccttgttgcatgaggtcaatggtcatcctgtctacccaccctgcctccaggccagggggctggggaggcaaatagagcccccctattttagtctttttaaaaaaaacatcctatactaagggcagaacccactgccccggcctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccatgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttctaa

SEQ ID NO: 25785 - DNA, 5137 bp, Homo sapiens
atggagcgctcgcagagccgcctcagtctgtccgcctccttcgaggcgctcgccatctacttcccgtgcatgaactccttcgacgacgaggacgcagaaggggacagccggaggctgaagggggccatccagaggagcacggagacgggcctggcagtggagatgcccagccggacactgcgccaggccagccacgagtccattgaggacagcatgaacagctatggctcagagggcaaccttaactatggaggagtttgcctggcgtcggacgcccagttcagtgacttcctgggaagcatggggccggcacagtttgtgggccgccagaccctggccaccacacccatgggggatgtggagatcggtctgcaggagcggaacggtcagttggaggtggacattatccaggctcggggactgacagccaagccaggctccaagacactgccagcggcctacatcaaggcctacctgctagagaatggcatctgcattgccaagaagaagaccaaagtcgctcgcaagtcgctggacccactgtataaccaggtgctgctgtttcctgagagtccccagggcaaagtcctccaggtgatcgtgtgggggaactacgggcggatggagcggaagcagttcatgggtgtggctcgcgtgctgctggaggagctggacttgaccaccctggccgtgggctggtacaagctcttccccacctcctccatggtggacccagccacaggccccctgctccggcaggcatcccagttgtccctcgagagcaccgtggggccctgcggagaacgatcttagtgctggaatggggaggggctccccaagatggcctggagaccacccagccctgacctgggaccccaggcccaggggcacattgaacaggaggacggggctctcccccacagtggggaagcagaacggggagacctgcccccccttgggcccctcctcaccccttctttgcctcctacccccgagacctcccctctcccaacgggattggctacacttttgacttggccggttcttgacctggtggatgtggctgcagtccagagaaaggaaagattgaggtggcagagcagaccactctcccttcccaaactgtccaacttctccccctttttgcctcctcggaagctcgctgcccagagccatgtccagaacccagccggccatctccatggtgccaattaccagcaagtgtctttcctgcggcaccgggttcaggcagctactcctgccccagagatgaaggggcagctttgcaaggatccggagccagctcccaggggcccagagccccccacttgaagaggagcttgagcttccctctgcctgcccgtggaaggagctttgccgcagcctgtccgagtccatccgtccgtcccctcctgcctgcccctcttctggtggctctaggaattggggttcagcagggaccaaaggaaaggaggaggtgccgggggcctggcacagacccctaggtgcctcgctccatgggattgcaacaagctagtttaggaaccgctggcggactagaaagaatgttgtcgtctgtgttccggtggaggagctgtggaacctgagtttccagaaccccaaccctagagagcatttgggggtgctgtattggagggggaggctaaggaaagttgggattgggactggtggtgccaagataagggtttctcaaattggagaacccctccttgttgcatgaggtcaatggtcatcctgtctacccaccctgcctccaggccagggggctggggaggcaaatagagcccccctattttagtctttttaaaaaaaacatcctatactaagggcagaacccactgccccggcctcaattaccttggctgaaggaaagatggcggtaggagagaaaagtgaagaggcgtgagtgtaagaactgggagattccttttccagcaggcctgggtagctgccttcccagcccagccctccctggggcctgcgggagcccttttgcatgcaagggaggatggaggctggcccctctttatagaagcacatttctgccacctcccctgggaggcacccagaagcctgccactctttacctagtccctgctgtgtagggcgtagtccaggttagctaggtagagttagtgctccaagccctggggcctgttcttagctcatgcatagtccttacagagtcccaggaccgggggtggagaggagcctcaagtacattccaggagaccactgtctcctcgctggcctgggcctagatggggcagcctggctcacaggaggccagcccctcctcctccgcccccttccttcccttgtccccgtagggttatagctggagctgcctgttatactcggctgttctgatttattattcttggtactgactttctttatgagggactcctaagggttgtaggaccttggcagagggggcctggtctccattagagggtgttgttttctcctgaggacacccaggctgcctttggtcccaccctgttcctggtcccggtcccggtcccagtcccaccaggcaactccttccacccggaaattcttcccttcccttagcctgtggaaaccctgggtattctttaaagttctggtcaatgtatatcacctccacagagctgcttaccctgcactgggaaggggagatggagacgccccctttacccaggaggtcttcagagtttcctgggaccgcggtgggtggaatcccaaggctgggggtggaaggagcagggctctggagggattcgcattcaaggcacagaattggccccttgcctgtttgtttttctaaccagtgtgatttctctgctgttcgtttattacttaccattggaatattttgagccaggagagcgccttctctctccagccatcaccgctgtggttgttcaggggtagcttttcaaaaacagggcagagcctggctgtcccaaccagggggagcaggggcttggccctgacagcctgagcccttcccctggtgtctgcacagcctttataaagagagagagagctccgaagcaataacaacacctgggggtggtcagtgagggccccctcaatgattttcttgtttgttctgtgaaatcccgctcacctcctggaggggtggagcagctgggggctggagccctgtttctttgtgtcatcgtgagcatgtgccccttcccaggggctgtgaccattgggtgtgggaactacggtctgtcctcaccaagggatgggggtttggggaggagagtgacattttcatcattagcttcggagaagcttcaagcccatcctgtccccgctactgcctggccccttgctgactcaggctgcactgtttgaagaggagcagagaggctggcactaggggccactggggggctggggtctccaggggatgactgttttcaatctctgggccaagatcacatgcaggataccatgggaaggagccatctccactctccttctccagaacccccttgaagggcctttgggaccattagtccatttccattttacagacaaggaaatcaagacccagcttgggggaaaagccacccctggagtcacctgtgtgttcagtggcacccccagcctgggtcccctcctcccaatagaggctgagccggagccagggcagtatgaggtggggctgccactgcccatacctcctcctcccttctttctttgaagcctaatggccccccaaaagatgggcaggacaagctgtagcccatctgagaggttgggaaactgaggcccagaaacaggaagtgactcacacaagacccctcagcaagggtgcaaagggggaagaactaggggctccattgttcttcaggcgacaggagaccgttgctccagtgcatgtctgctgggacaaggattcctggcctcgaagccctgggctgcacagccctactgggctccacctctataaaccagtgacttctctgggcctgggtctgggggagagggttgccagggagactcagctctccttgggggctggcccagctgactgagggtacacaggattgggtctagaccttgatgcctgggtggagggcccttgtaaggggccatagcctcttcaggaccaactggagggagagttaggaaacaccagctcctgcctggggcagtgagggaatgggagcagctgtgggcgcctcatttcaggcaagtcctccccaaaccttcagatgcagtgagacctggccttcctgttgtgcttttcagactttgttttcagaatgcttttatctcgagtgtgcccttcggccctcacaagagcccctggggagtaggtggtggcctgtgccgtcatccccatttcaaagcagggagctgaggtcctgggaggggaaagtgcttgcctgaggtcccactgtgttagtgggtgggcaggactggaactcggttctccaacagcccagagctcactcttttacacccagaggtggagcaggtggcttagggggtggttatgtacttcacaagccaattcccttcagccaggagctcctgggtgcatttccgtgtcagaaacagtaccgagtcccaccccctctggaggcacagctgttgcgtcaggcaaggtcacctgcatttatttattgagcagcagtgctgtgtcaggcccagggaccgagcccctctccctgttcccctatggtgtctccgaggccctctgggagggccccacatctggagcagcacctcagagtggacagaaagcattagcgtccacgagctcacccgacgccgagcctgtgaggtgggctgatggtgcccgtctaacccagcgcttcagggaggtcagaatggagccgaacccagggctgtgagcatcacctctggagccctttcactttatgactgcttcctggacgggtggtgggaaggcaggagcctgggtccttaggctgggggcctctctccatccacccacctttccctcattccctctcttggagcagcagccgcccaggcctttagggagggagggtttctggggcccttgggttggagtggggtcgcgttgcattgtgttcatgaccatgtagctcatgttgaaattaaagtttttggcttttct

SEQ ID NO: 25786 - DNA, 2490 bp, Homo sapiens
gcctgccgccgcgcgattccgagggggttaacggcggagccgccggccgggcgcggaccggagcgcgtgaggctccggcgcgcaagcccggagcagcccgctggggcgcacagggtcgcgcgggcgcggggatggaggacggcgtggccggtccccagctcggggccgcggcggaggcggcggaggcggccgaggcgcgagcgcggcccggggtgacgctgcggcccttcgcgcccctctcgggggcggccgaggcggacgagggcggcggcgactggagcttcattgactgcgagatggaggaggtggacctgcaggacctgcccagcgccaccatcgcctgtcacctggacccgcgcgtgttcgtggacggcctgtgccgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 25787 - DNA, 2408 bp, Homo sapiens
tgtctgcctgcaagcatgcaggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 25788 - DNA, 2404 bp, Homo sapiens
cgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacag

SEQ ID NO: 25789 - DNA, 2270 bp, Homo sapiens
ccccctgcgctctcgccatcgccccgcatttactcgctggaggagggggtcacctcattcctagggaggaggaaacagacattgagcggcgacgtgactcagtgttcataaataggacgacgtccctgcattcccaatctgcactattggaagaaaagccaatgtttgggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttac

SEQ ID NO: 25790 - DNA, 2686 bp, Homo sapiens
tttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 25791 - DNA, 2520 bp, Homo sapiens
atgatttgtgcatcctcttttgctcgcttaggcaaattctggatttgtgttagagtggtcagaaatgccaagaacctgacttcttagattaaaagacaaaattgttggggggagaaaggttttttaatggtctgaacattttctcagttcagagcctgagatctgcatgagctcaccattgctctcgttaagtaatgttcactggctcaccgtggaaacttgaaggcatgtcagtgtacctgaaccgtgcctttttcaggactaactcaaagaccttcaggaagaaatatttgggtacagccatccgggaccacagaatcacagggcaggaatgtgaatgttgatgctggcgattgtgagctgcctgaccttaggcaagtagtctcaattcaccaagcctcctttcttcaaaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 25792 - DNA, 3240 bp, Homo sapiens
ccagagggcgccagcgcccaccaagcgcagaagcccgggaggaccatccaggggctccccgacatttcctcagttagccagagtcggggggctcagacatctggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 25793 - DNA, 3186 bp, Homo sapiens
ctctgctgtgctgcctcagacgcggagggctgcgtgcagtgggagcgggctccaggagcccgagcctccagccgtccccagagcaaggcagcaccgaggcctggccacagcaatatccatctggaagctcttcccttcactcccaactctgaggttgcctaactctttattaaaaattcagaagggggaatgccagcccctagcatggactgtgatgtttccactctggttgcctgtgtggtggatgtcgaggtctttaccaatcaggaggttaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 25794 - DNA, 3327 bp, Homo sapiens
agagggaggcggggcgcgccgcgccgcgtacggccccacgcaaaggcccgcgggcaccgcgccgcccccacgcgctcgcaccggcgggcaggtgagcaggcagcgccgcgcgctagcagctggcccccgtagacgccccagccgccgcctccgcctccgcctccgccggcgcatcgcggacgcccagcaggaatgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactgagctgcctgctccttctcgataatagccgtctcctctttatcatgctttttccccctgttgtttgtcaaaaaaaattgcctttaaattcctgggtgtttggttgtttgagattccttccttgttatcaagcctctcggacaaaagggctaggaaaaggtgatatgtctcctgatcatatcatacccattaagtataacccattatttagaaggttctagggaaaaaagtagtattttcttattaaacaatcagcacagcctatatctttgttctctcatgttgatccaagccagagacatcagtaacaaatagcacctgtgttgtttgtgagctgtttcagtcccagtcctgatgtgtgtgcgttgttctctcctggccacttaaataggaccatatgtaaacttgactttgactgcatgagatatccctatctggtctcactcagtcctctgcatcccaacattcccaggacatgcatgatcaccagcatttattttcattatttgaggatatcttataactcacagattgtcagcatccagccatgtcctatctagattaggaaaatgatcagaatattccagctcaacaagtctgggtatattcactattgtgagtcaatacaccatagctctgttgaaattcctggaggcaaaattgaccttggccccaaagatattcctcaatagatttcaaacaccactcccctgtagaactctcccagcctcgttggggaggcttgtccagggtgatagagactgatttcagacaaacctatttattacaaaagtttcatggtgtctgaatgattgttttctctctttgtatatttgtacaaatgtttcagctgtgcttttaaaaaatctggatgttttttatttagtgattgttcgacaattagctgcttcaaaacataatgtgcattgcttatgaatgccttcatatactaatacagatactctgataatattacactctaataaggataatgctgaattttgaaaggacacaaaacatctaatgccaatatatacatgattagccaacatctttgctatcaagaccacttgtttttaaataaagatgcaagtgtcagttgtagattattgggatgaagctaaatccccagaatgcagcagcagctgagcatgttaaaatggggaaggatgatagctacatgtatgccggtcctactcacgcgacacccgtgtgctcaaaaaagttatttgtttttgttacgtgtgatttttctatttctctagcccaaagtgcattacagaagatacacctatagaaccattaccttctgctatgtgtgccaggcctcatctactcctgtacattaatgaattactttagatgcaaacgcagattacaatggagtggggaagtactttcattacccaagcctcagaaaaacacacaagaacaataacacagcaaacagattgagggattgttgtggtttttgactaaggtgtatgttagtttcatcagaaacttaaaacatagactgatcactcagaaattaaagtccgttttactgtgaatatagcaatatagtactggacacagtactggtgaaactgaggagagcattgcttgtaaaatcctgagtttccataaggaaaatgaaaactccttttaaaaataaaatctgaggagtgtacaataagcatatgctttgactttcctttgctgtggaggtttttggtttttcattgatgataaacgactacagacttagtagtggagaaatggtgtcctctagtggaagaaatagtaggctccgctattcagatgcagagcactgcagcatccagcctttcaaagctgactcttctcaatcatctgtgggtcatttgacttgattttttaagctaccctgaatttccagaatgcaggttctaaagaaatctagatgagagaaagtatttgaaaatgatttttaaatgttttttaaaagacacatctgacatttttaacaacttagtaaaagttgaaatgaccattctgtgtagtcataaaagaaacacaatgaagtgtatggcctctggagttagtcttagtaaaacttattgctctgtgtcaatgttaacctgtctcagatcaagtaattctttcactaggttgggtttggggaggggggaaaagaggggcttttcctaggagaacgataagaaatggaaagactccttgaagtgttgcaagggaacctcctagcactgtgaaagtcagaatcgcctcagcatttccatgacgcacattatgcaaatctctttagcactattttaagtttgaaaactttaacaatgaaggggaaggggaagatttccaccaactgaatcatttgtgcacgtgtatagctcaaagagcttagacttcaaatatatctggtgaatg

SEQ ID NO: 25795 - DNA, 732 bp, Homo sapiens
atgaggggagaatcatacttcatcggaatgaggagcccagggcagcagggacacgtccctgaagatggaggacttttcttactgtgctgcatagacagggactgggctgtcactcgttgttttgcagaagaagcctttcaagcaatcactgacttcaatgacctccccaactcgttgtttgcgtgcaatgttcaccagtcagtgtttgaaggagaagagagcaaggaaaaatttgagggactgtttcggacttatgatgactgtgtgacgttccagctatttaagagtttcagacgtgtccgtataaacttcagcaatcctaaatctgcagcccgagctaggatagagcttcatgaaacccaattcagagggaaaaaattaaagctctactttgcacaggttcagactccagagacagatggagacaaactgcacttggctccaccccagcctgccaaacagtttctcatctcgcccccttcctccccacctgttggctggcagcccatcaacgatgccacgccagtcctcaactatgacctcctctatgctgtggccaaactaggaccaggagagaagtatgagctccatgcagggactgagtccaccccaagtgtcgtcgtgcacgtgtgcgacagtgacatagaggaagaagaggacccaaagacttccccaaagccaaaaatcatccaaactcggcgtcctggcctgccaccctccgtgtccaactga

SEQ ID NO: 25796 - DNA, 3816 bp, Homo sapiens
cagagatgtcggcttatttataggaattgcttgaagccagagtcatggtggatgtcggaaagtggcccatcttcactctactctcccctcaagagatcgcgtctattcggaaggcgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcctgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccacgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacattaaaacagg

SEQ ID NO: 25797 - DNA, 4025 bp, Homo sapiens
gacccggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggcgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcctgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggagcatgaagactttttaacagttgcagagtcactgaagaaagaatttgatagtccagaaactgctgatctgaagtttcgaattgatggaaaatatattcatgtccataaagctgttttgaaaatcaggtgtgagcattttcgatccatgttccagtcgtattggaatgaagacatgaaggaagtgatagaaatcgatcagttttcttacccagtgtatcgtgcctttctccagtacctctacacagacacagtcgacctgccgccagaagatgctataggtcttctggatttggcgacatcttactgtgaaaacagactgaaaaaactttgtcagcacattatcaagagaggaattactgtggagaatgccttttcgctattctctgctgcagtcagatatgatgcagaggatttagaagaattctgctttaagttttgcatcaatcatttgacagaagttacacagactgcagcattttggcaaatggatggccctctgctaaaggaattcattgctaaagccagtaaatgtggagcctttaagaactgaagcgcaaggctgctgggttctgtgtgagtgctctggggcactgttgaggatgtgtccagtttgtgctctacgggtgatgtgattctgcaggtaaaagaccatcaggttgtttttttccacatctgggacacagttgtttgtgtaggaacataacaagggtgtacggcttttcttgagcccattttaaacaacccttgtttccagataagtgtattttaaatgtgacctttcgtaaatttgggctggaacatgtaaaagggtgaaagttagtcgtttttggtcttcttttcatttttgattagaggaacttctgaacttggaaaggggaagttggcagcaactctcctgggccacgtatcaacaatcttctgacagcaggagcagtgatagttggggaattgtgagatgaatggagaggccccatcgtgaattaaagatgctgacctggggattgttaagtgctgccttagttgctagtttagtagccttactgtgaaggaataattaagattgtttcagacttttgtttgtgtgcttgcgttgatgacttttttaacttcaagataaatcaaagtaataagtttaacgtatattaaacctgttgaaatgataattatgtaaagataaatattctaggttagtcaagatttctcttaagatttaagtgcataaagaatagtaatttagaagtatccgtgaaaagttgataatgaaagaaatttgatgaaggtgaatattttataaattagaatctccactacttatccaatggtgttttatttcattaaggtagaacttgagaactcaagtttaaattgtcccccaccaccttcttctataaatgcaaacttaagaggaaaataatgacatgtatagtatactcttgccttcctaaattatgactgctgaatcatcatatctactatatatgactggaagaagtggttcttcaagtcaaccctcttacaagacttagtggaatttgctttatctactttaggccaaatccatcacacattggcttatgtgaaactttatcatctttcacttttggttttcctctgtttttaaacatcttaggtataacagcacaatttcaccttgaaaaagcaccaaaattatggtgttcctgaaaagatcctattaaaagacagtagtttatttgaactggttatggaaggtgactttgggatgtaagagtgttcaactgtgagtttcatcatgtgtgtccgttgagcttgcttttaagagcaatgttttgctttgctctctggtccatgaactcatttccatttgagtgagttcccttagtgaattttgtctcctgcttggaaagtctctcttctgaacctggagcctgaatacattttcagagccaaattacaagtgggtgaagacatgctacaactactatttttagcaatgtttttaaatttgtgtctattggggtgggaaggggagtgaggccctaaagataggaattcactgatagctgaaatagatacaagcctaggagccccagcccccttttcttgaccatatcacaagtgattgaagcccagtgaattagtcggttagaattcgttctacaacatgatagaacttttcttactagcttcagaaatgcacattgatttgtgctatgatgggtggtgtttgtaacaatcactgttctataggcttatgatctgagcaaaatgtgaacttcagtatgtttactattgctcttacttgaaaactttttttcaaaaaaagcacaaattaaagtagtaaattcatatccatagatagttcattcattcaacaaatatttaccaagttcctaatataagtgaaggaccacttctcatattagattactaagtcatttgtatgaatatgtgtggcagtgaagagaacaggtctttcaaaaagcatttgattattttttttaaatacactctcttatttttctacttgtttttttgttaatcatagcaggatatgacaactcttatttgaattgattttttcatctaatgtaataatggaagccaaagtattcatatttcttaagatagccctaaatgtactcttgaacttcttactggaacaatgtttgatactctagtatgtaagctgtatttatgtaatatttagaacgacatgttaataaacaaagtaacatt

SEQ ID NO: 25798 - DNA, 1971 bp, Homo sapiens
ggcgggcccggcgccctggcgctcctcctcttcgctgccggtgggcaccgccgctcgctcgcacttctgcgcccattggagcttcggagatccctgcggtcccgcgggacggcgcggcagcagctgacctcgcagacaggatcttgctctcttgcccagactggaatacagtggtgtgaacacggctcactgcagcctcaacctcctggactcagagatgtcggcttatttataggaattgcttgaagccagagtcatggtggatgtcggaaagtggcccatcttcactctactctcccctcaagagatcgcgtctattcggaaggcgtgtgtcttcggcacctcagccagtgaagcactgtacgttactgacaatgatgaggtctttgtatttggactgaactatagtaactgtctaggaactggagataaccagagtacacttgtacccaaaaagctagaaggcttatgtggaaagaagattaaaagcctcagttacgggagtggaccacatgttcttctcagcaccgaagatggagtggtttatgcctggggccacaatggatatagccagcttgggaatgggacgaccaaccaaggcattgctcccgtccaggtctgtaccaatctcttgatcaagcaagtggtggaagtagcttgtggctcacatcattcaatggctctggcagctgatggagaggtgtttgcttggggttataacaactgtggccaagtgggatcaggttctacagcaaatcaaccaactcctcgaaaagttacaaactgtttacatattaagagggtagttggcattgcctgtggtcagacttcatccatggctgttctggacaatggcgaggtatatggctggggttacaatggcaacggtcagctgggcctgggaaacaatggcaaccagctgacccctgtgagagtggcagctttgcacagcgtgtgtgtgaaccagattgtctgcggttacgcacatactctagcactaacagatgagggcttgctgtatgcctggggagctaacacatatgggcagctgggaactggcaataaaaataacctgctaagcccagcacacatcatggtggagaaagaaagggtggtagagattgcagcctgtcactctgcccacacgtctgcagccaagacgcagggtgggcacgtgtacatgtggggccagtgccggggtcagtccgtgatcctcccgcacctcacccacttctcctgcaccgacgacgtgtttgcctgctttgccactcccgccgtctcgtggcgcctcctgtctgtggtgagtattgtgattggaaaataattggttcactgaatgggactatttggccagaattgcacatgtatggcatacccagctgaagcacttctgtacacatcttcagatttgtatatactacttaacctggacttgttataaaaggcttcccccagttcttatatcttaaaatggcacaggcattcttttcagaacaaatgtcctaacaatttaaatgttaagtttggaaaaaatatggtcattgactatatcctcctagatcaggggtccccacaccccaggccatatgcctgtactggtccgtggcctgttattaactgggttgcacggcaggaggtgagtggcagtgagcgaagcttcatctgtatttacagctgctccccatcactcacattaccgcctgagctccacctcccatcagatcagcagcggtattagattctcaaagaagcgtaagccctattgtgaactgcacatgcgagggatacaggttgcgagctccttatgagaatctaatgcctagatgatctgtcactgtctcccatcacccccagatggggccgtccagttgtaggaaaacaagctcaggactcccactgattctacattatggtgagttgtgtaattatttcattacatattacagtgtaacaataataaaaattaagtgc

SEQ ID NO: 25799 - DNA, 3232 bp, Homo sapiens
aggagaggaggggcgagacgccgtcgccagccccctcctcttgtctgcgctcccttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaacaaa

SEQ ID NO: 25800 - DNA, 2400 bp, Homo sapiens
gcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgag

SEQ ID NO: 25801 - DNA, 2656 bp, Homo sapiens
atgcttcaagatggcagctgtaagcaaatgcttctaatgctgctgatagttcagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataac

SEQ ID NO: 25802 - DNA, 2815 bp, Homo sapiens
ccgtgcagtaaccgctacccaggaggcggagcggacaaggctccggcctgcgaggagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataac

SEQ ID NO: 25803 - DNA, 1316 bp, Homo sapiens
gcagtaaccgctacccaggaggcggagcggacaaggctccggcctgcgaggagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgca

SEQ ID NO: 25804 - DNA, 1062 bp, Homo sapiens
gtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacg

SEQ ID NO: 25805 - DNA, 1577 bp, Homo sapiens
ttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggacacgagggccgctgcctcccgccgcgttcctggcgcccgctcctgccaaggtgcctgcgggccgagccctcctgaccagaaaacccgaccagtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttt

SEQ ID NO: 25806 - DNA, 2424 bp, Homo sapiens
ccagcccgggagcgcgccacatgcagatcctgggatggccgccaggggccgccgggctctttgttttcctttctcacccgggtcggggccagaggcctgcagagcgcatgctctggggcagttcgcggcccggcggggagcgccggagttccttgtggccgacgtgcaccaaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttat

SEQ ID NO: 25807 - DNA, 2534 bp, Homo sapiens
gattcgcagtggtcgcttcttctccttggatttgttaaggattccaagtaactcttatttggagagaagacgatctgcacttcgcattttggcattgacatttaattttagggtcctttatatagaagggagactacatgaatgtgtaagatcttggaggaagacagcagagagagagagagagatcagagatcccagggttaaaagttggagaaatttcacagtacatcatccaaaagaggagtccatgatggaggcagaggtaaacttggagaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaatag

SEQ ID NO: 25808 - DNA, 2715 bp, Homo sapiens
gattctctaactgcgcatgcttctgcgcacgcgcaatagacattccaggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccccagaacctaacatccttcaagaattccaccaagtcctgggtgggcttctctggtggccagcaccatacagtctgcatggattcggaaggaaaagcatacagcctgggccgggctgagtatgggcggctgggccttggagagggtgctgaggagaagagcatacccaccctcatctccaggctgcctgctgtctcctcggtggcttgtggggcctctgtggggtatgctgtgaccaaggatggtcgtgttttcgcctggggcatgggcaccaactaccagctgggcacagggcaggatgaggacgcctggagccctgtggagatgatgggcaaacagctggagaaccgtgtggtcttatctgtgtccagcgggggccagcatacagtcttattagtcaaggacaaagaacagagctgatgaagcctctgagggcctggcttctgtcctgcacaacctccctcacagaacagggaagcagtgacagctgcagatggcagcgggcctctccccagccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgtcctgaggtgccaaccagctgtcagtgtgactgtaacaaaggcttcaaatctgtcaagaagtaaggaaaagttttgtttg

SEQ ID NO: 25809 - DNA, 903 bp, Homo sapiens
ggacttccgggcacttcgtaaggtttaaaaaggatgcttcgcgttttctctctcctttttggagacagattcgcagtggtcgcttcttctccttggatttgttaaggattccaagtaactcttatttggagagaagacgatctgcacttcgcattttggcattgacatttaattttagggtcctttatatagaagggagagtaggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatg

SEQ ID NO: 25810 - DNA, 1121 bp, Homo sapiens
ggcatgcgcttggagaaggcggtttgcagatcggggagggagccctgcccgggagagggtgggtcgtaggagctcgagggtctcccgctgtggacctttgggagccgtgtgtcttgaactccgcagcagctcagtctgtcagcagattatttgctggccatttattgcgtccctctcttgcggggctgggggacagtagtgagaagagcaggcccgtgtcattagcgaactatgcccttgaacccaggcgacggacgctactggacaggaagatgtcacccaagcgcatagctaaaagaaggtcccccccagcagatgccatccccaaaagcaagaaggtgaaggtctcacacaggtcccacagcacagaacccggcttggtgctgacactaggccagggcgacgtgggccagctggggctgggtgagaatgtgatggagaggaagaagccggccctggtatccattccggaggatgttgtgcaggctgaggctgggggcatgcacaccgtgtgtctaagcaaaagtggccaggtctattccttcggctgcaatgatgagggtgccctgggaagggacacatcagtggagggctcggagatggtccctgggaaagtggagctgcaagagaaggtggtacaggtgtcagcaggagacagtcacacagcagccctcaccgatgatggccgtgtcttcctctggggctccttccgggacaataacggtgtgattggactgttggagcccatgaagaagagcatggtgcctgtgcaggtgcagctggatgtgcctgtggtaaaggtggcctcaggaaacgaccacttggtgatgctgacagctgatggtgacctctacaccttgggctgcggggaacagggccagctaggccgtgtgcctgagttatttgccaaccgtggtggccggcaaggcctcgaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggaactccgggcacagaatcttgcttcataccc

SEQ ID NO: 25811 - DNA, 2894 bp, Homo sapiens
actagaggtggggttagcgcttggaagcaccgaccaacgtgagcgcaacgcggcagggacacctgaccccggcggcgcccagcccctcggattgccagtcactgctcgctttggggcacggaggtgcccagtcctgcggggcacccgacgtcctgtcgccgacagggtccgggagtcagtatagctgggttctagtcccatcacaggcaaaaactccgcgggagcctggcccgctttttacctgggcctcagtttccccatccgtaaaatagaacgggttggatctcccgagcgctaacattccagaactcggatggggcgaaggggagggagggatgggccacccacacgtgacctccccgcgtggagccccgcctaccactgatccagggggtggcagctccggccgggacgagcggggtgggcgggtcctaggaaaccctacccggccgcccttggcagcgcctaaggcggagcgcgcggctctgcagcctgcttgccccggagttggcacccacggaggatggggaccgcaccctcagcttcgcagggagccaccgtggaggccagggcggtgcagagacacgacgtgtgactcggagtgcgcctggggaggatggacgagggagcgggggaccgctaacggggctccctctgcgcgccccgtccgcagaggcgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacgcgccgcggcggccgctggtgcgcacaggtgtggctggcgcctcctccggcgtggcggcgcgcgcgctgagcacccgcagcctgcggctcgaggcggagggcgacttcgacgtcgcggacctgcgggagctggagcgcgaggtccttcaggtgggcgagatgatcgacaacatggagatgaaggtcaacgtgccccgctggaccgtgcaagcccggcaggcggcgggcgccgagctcctgtccacggtcagcgccggcccctcctcggtcgtgtccttgcaggagcgcggggggggttgcgaccccaggaaggccctggccgccatccttttcggcgccgtgctgctggcggctgtggccctagccgtgtgcgtggcgaagctgagctgacggacacccgacggccgcctgctgctgccgctccctcccctgagaaaagactcgggatgggtgtggggtctggcctgtgcaaggggagtggtcctaaaaccccgtgtgtgcatgggtacacgcgcgtttccagtgcacatctgcctgggcaggacacggtttcctcttgctggcccgggaggagttaactttgcgccggccgtcagggcattaccgctaacgtctgcaggagctttattccctattaatagaaaaccgtcacagtgaccctagatccctccgagttaatgagttaacacatgtgctgttggggcgtctttacagggagtccgagttcggtgcccacccctgccagcgtcgccccctttctgcgtgggacagtttgaaaaggtgggtggggtggagtgaagtttggagagggacgctgtttggttctatgtggttggtctgtttcccggacaagaaaaattgcaatcaaatgtcagcagcttttattaccttaatctttcagggcctaaatttaggagagtgtcccgagagcagttcatacaaagggctttctctaagacgcgctacagcccttcctagcagagtttatccattcgtccccaagagcagctagaagagatttgaggtcatgacctcccactgccgctcaggggctgaccctatttaggaaaccaaagagggtgggttgaacctactctcacggacttggatccagtgcgcacacttgcctgcggaaaagggctctccccagccacccggagatgggggtaagaggaagagcagaggcttggggtagggccacctggtgtttaaacaggcactttctccttctctggggcttatttttgttcagaactagaccagagtgtttgaacctcctttgcaggagggctgggaatcctctttagagcacttaatcctatttatcccctggaatgtgcgtgctggccagtaggagggctggctttggcagctccctgacccccgcgctgcccgcccctccggggtaatgtggcattactggcccacagaggttttgagccaatcagctctgagactgggttagaatgtaacagctttaacttgggatttaagaagcttttaaaaggtaataatactctgaaagaaaaatgacgtaaccacagcgtgtactatgaaagctgttattttaataaagaacgctgggccatgaactcatacctgccaatgagtcaaacatagtatctttatgtagatacttagattactaaatatatatttcatctacttctgaagttgatagtcttcccccccccccacttttttcttttttgagacagg

SEQ ID NO: 25812 - DNA, 1405 bp, Homo sapiens
gcctgtctgcattctactatataaagcagcagagacgttgactagcgcatatttgctaagagcaccatgcgcgcagcagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagatctatgatcccacatctggaatctggaatgaaatcttccaagtccaaggatgtactttctgctgctgaagtaatgcaatggtctcaatctctggaaaaacttcttgccaaccaaactggtcaaaatgtctttggaagtttcctaaagtctgaattcagtgaggagaatattgagttctggctggcttgtgaagactataagaaaacagagtctgatcttttgccctgtaaagcagaagagatatataaagcatttgtgcattcagatgctgctaaacaaatcaatattgacttccgcactcgagaatctacagccaagaagattaaagcaccaacccccacgtgttttgatgaagcacaaaaagtcatatatactcttatggaaaaggactcttatcccaggttcctcaaatcagatatttacttaaatcttctaaatgacctgcaggctaatagcctaaagtgactggtccctggctgaagggaattaacagatagtatcaagcgcagaaggaatgtgccagtatggctccctgggtgaacagcttggccttttttgggtgtcttgacaggccaagaagaacaaatgactcagaatggattaacatgaaagttatccaggcgcagagttgaagaagcataagcaagacaaaaacagagagaccgcagaaggaggaagatactgtggtactgtcataaaaaacagtggagctctgtattagaaagcccctcagaactgggaaggccaggtaactctagttacacagaaactgtgactaaagtctatgaaactgattacaacagactgtaagaatcaaagtcaactgacatctatgctacatattattatatagtttgtactgagctattgaagtcccattaacttaaagtatatgttttcaaattgccattgctactattgcttgtcggtgttattttattttattgtttttgactttggaagagatgaactgtgtatttaacttaagctattgctcttaaaaccagggagtcagaatatatttgtaagttaaatcattggtgctaataataaatgtggattttgtattaaaatatatagaagcaatttctgtttacatgtccttgctacttttaaaaacttgcatttattcctcagattttaaaaataaataaataattcatttaagattctt

SEQ ID NO: 25813 - DNA, 1748 bp, Homo sapiens
tagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgcc

SEQ ID NO: 25814 - DNA, 2415 bp, Homo sapiens
tttctatagagacacttcctgtggcagagaaaagaggtagtgagcggtgtttcaggatgtgagggcccgcaggagccgagtcaggctctctccactgcctgcccgccaccgtgcaagctctggccggcgctgcccacagtccccatggtgggcagcccccgcggcggggacccctgatcggcagcggcatgccagggaagcccaagcacctgggcgtccccaacgggcgcatggttctggctgtgtcagatggagagctgagcagcacgacggggccccagggccagggcgagggccgcggcagctctctcagcatccacagcctccccagtggtcccagcagccccttcccaaccgaggagcagcctgtggccagctgggccctgtccttcgagcggctgttgcaggacccgctgggcctggcttacttcactgagttcctgaagaaggagttcagcgcggaaaacgtgactttctggaaggcctgcgagcgcttccagcagatcccggccagcgatacccagcagctagctcaggaggcccgcaacatctaccaggagttcctgtccagccaggcgctgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgcagccaggccacaatgggggaggtgagtccagccccttggaacaggcttgcccaacatggagggatggcgttggcagtgccagcctccccagcctgtgccaagcttcaacaggggcaagaggaggggccggcccctcctcaggaagctggtatgagtaaggccttgagggtgcaggcaggcagccctgtaccccacccacatagactatactgtacatacagattttgcagtaggcttggggcagctgggtttgtccttgatgtatgatactgttattataataattattattattctgccatga

SEQ ID NO: 25815 - DNA, 1536 bp, Homo sapiens
tgagcccagtgaacatcgaccgtcaggcctggcttggcgaggaggtgctggccgagccccggccggacatgtttcgggcacagcagcttcagatcttcaacttgatgaagttcgacagctatgcgcgcttcgtcaagtccccgctgtaccgcgagtgcctgctagccgaagccgagggacgccctctgcgggaacctggctcctcgcgcctcggcagccctgacgccacgaggaagaagccgaagctgaagcccgggaagtcgctgccgctgggtgtggaggagttggggcagctgccacccgttgagggtcctgggggccgccctctccgcaagtccttccgccgggagctgggcgggactgcaaacgccgccttgcgccgagagtctcagggctccctcaactcctccgccagcctggaccttggcttcctagccttcgtcagcagcaaatctgagagccaccggaagagccttgggagcacggagggtgaaagtgaaagccggccagggaagtactgctgtgtgtacctgcccgatggcacagcctccttggccctggccagacctggcctcaccatccgagacatgctggcagggatctgtgagaaacgaggcctctctctacctgacatcaaggtctacctggtgggcaatgaacagaaggccctggtcctggatcaggactgcaccgtgctggcggatcaggaagtgcggctggaaaacaggatcaccttcgagctggagctgacggcgctggagcgcgtggtacgaatctcagccaagcccaccaagcggctgcaggaggcgctgcagcccattctggagaagcacggcttgagcccgctagaggtggtgctgcaccggccaggcgagaaacagcctctggatctggggaagctagtgagctcggtggcggcccagagactggttttggacactcttccaggtgtgaagatctccaaagcccgtgacaaatctccctgccgcagccagggctgcccacctagaactcaggataaggccacccatccccctccagcgtcccccagttctctggtgaaggtgcccagtagtgccactggaaagcggcagacctgtgacatcgaaggcctggtggagctgctgaaccgggtgcagagcagcggggcccacgaccagaggggccttctgaggaaagaggacctggtacttccagaatttctgcagctgcccgcccaagggcccagctccgaggagaccccaccacagaccaaatcagcagcccagcccatcgggggatccttgaactccaccaccgactcagccctctgacagctacccaacagtccaggacagctgcatggcacccggcgggccgagcatgccatgggtccgctctgcatgccctgtctgtgccatgagtgtccctggccccttcctgccatgggcaggcccgcaggaagagccggtaggggtggaaaggggactcagatgagacacaccccacagctgccaccgccttgtccctcaacaagctcacccccaatcccttgca

SEQ ID NO: 25816 - DNA, 2427 bp, Homo sapiens
gcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagagagccaaagagttcaagacacgtctggggatctttcttcacaaatcagagctgggctgcgatactgggagtactggcaagttcgagtggggcagtaaacacagcaaagagaatagaaacttctcagaagatgtgctggggtggagagagtcgttcgacctgctgctgagcagtaaaaatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggtcaacattgaccatgagacccacgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatggcaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatga

SEQ ID NO: 25817 - DNA, 1794 bp, Homo sapiens
gttaccacttggaaaacaattcatctgaaagaagcacagattttctcatctatcctgtcaacaaagaaggaatcaagagagcaaggacagtgatttcccctgcattgcatttgtcttgaagatcagtcagaaagagaaactcggcatcatctgtgacagacagtggaacgaaaaatgccagtgaaatgctgtttctacaggtcaccaactgcggaaacaatgacatggtctgaaaatatggacacgcttttagccaaccaagctggtctagatgcttttcgaatatttctaaaatcagagtttagtgaagaaaatgttgagttctggcttgcctgtgaagactttaagaaaacgaaaaatgcagacaaaattgcttccaaagccaagatgatttattctgaattcattgaagctgatgcacctaaagagattaacattgacttcggtaccagagacctcatctcaaagaatattgctgaaccaacactcaaatgctttgatgaggctcagaaattaatctattgtctcatggccaaggattctttccctcgatttctgaagtcagagatttataaaaaactggtaaatagccaacaggttccaaatcataaaaaatggctcccttttttgtgaggaaggtaaaagttaactaatcactatacttcagggctacaatattttaaatatacaagcatgatgcattgtcttttgttttgtttttaggatttagaaaacattttttacccaaacagatgaataacgttttatacaacaagcctgaatttctaactcagttgtttagaatgtatttgctttaccagctatttaatctcctactgggggagtacaaagaaagtttatagagatacaatatagtcttaaaccaaaactgaatattcttattatattataatgtaaggaattatacatatcttcacgtggcagaatgaaagacttttgagcatcatatacacaattttaaataccattgctttattcaaaaaaatctcacttttgtaaaaagagaatttctgaaccaaaatacaagctttcatttaatatatttaactgttttttttctgccatttctttccaactatttctaataatgtggttatgaaaactgctacgcctctcaaattatattttttaaatcacaggaatgtatacacatttatatgtatgtcttgaatgcaccatggaccaaagtttttcaaaatatatcacttggctcaattcaatggcatcacatataaaatgtgatgagttatgtatgaaaaggcctcaagggtggggaatactgattttcttatgttaacagaaatataaaagaaagtggaagactaaggagcatagataaatccttataagatgaagtatatagcaagtcataaaatttaagaatttgcaacattatctactcaattgtggggaagtatctattcactccttcagcactgatacttgtttataaaacccaaacaatttttaaatgcatttattttgagatgttcctaaaattgtttcattctatatgtaaatatcctgtgataaatacgaataatttcatttcaatatgagaagctgtaaagattcaacagatctcccacgtttccattttctttgcacagatttatttatctgcattgatatttctgcttttagattgtttgaacattaaaaaatggaggaaaaatagcatggcttattttatgttttcacaaactactcatttgatagacaaaattttgtcttcccttcatcatgagaaataaacatttaaacatattcaaa

SEQ ID NO: 25818 - DNA, 2542 bp, Homo sapiens
ctccggttactggggagcaacacagccgcctcgggttgcagacgctcctgtccgggtcgcagtgggacgccatggagcgctccctgcaccgcgtctccctcgggagccggcgtgcccacccggacttgtccttctacctcaccacctttggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagaaactccaccctttcggctctctccagcaggagatggggccggtcaactcaaccaatgccacccaggatagaagctttacctcaccaggacagactctgattggctgagcaaacccaagggcgggactctgcttctggcaacttaaccctttcttgggcatcccctaccacacagtaacctcacctcaactggacctgaaacagaggaccaagatggtgggtctagggtcatctgaagggagtggtcccaagggtgcatgtggatgtcaacagaaggaccacaatggtgtgagaggccttgtgggcatgcagagactggcagcagaaagtcccaagaggagaggactcagaggcttcttccttccaaggaggaggaggaggaggacattccacatctgggcttccagtggtggctcccggacctgccttgggggcagcaggagaggttgggagaggtcaccctgatgaagaacaatgccatgatctgctgctgccagaggacatctccgcccatccactcattttccacctgtacacattggctcattcattcgatggatatttcgggtgcatctactttatgccaggctctatgctaggagctggggatactgtggagaaaaagtcggatatggtctcgctctcatcaagatttcagtctagctgggagtgagcgttaaataagtcaataccaacacacacacgtgcacacacgtgatggcaagctgtgatcatctatgaaagaaaaaacacagatttctttaagaggg

SEQ ID NO: 25819 - DNA, 1582 bp, Homo sapiens
ggatggacgcctctcccccggagcagcactttggggccagcttgggccctggggatgagccacaggggacccacagcctatgcgtgtgagcatgtaacccgggagccagctgggcccctcgcggggtgggcagaaggacgggctggcccaggaccctcttctttgagacatcccggactccatctcggatgaaagtgctttgagaaaccacagagttttctgtttaatggaagaaagaaatccagcctctctccagagtggcggtggccggctagacaggagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 25820 - DNA, 3689 bp, Homo sapiens
ttggggaggtgagaggtgatttcctgccattcttctgtggggcgggcttcccagggtgctcatgccaggctgacgggtccagtgcgggctcccgctgctgggggagagctgggttttcatggggcggcagccgaggcaggacccgcagccatgaaccgcttcaatgggctctgcaaggtgtgctcggagcgccgctaccgccagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 25821 - DNA, 4398 bp, Homo sapiens
gccaggcgcagtggctcatgcctgtaatcccagcactttgggaggttgagatgggcagatcgcaaggtcaggagatcgagaccatcctggctaacaggtcacattcagacagcacacctttgcccaattttctttctggatctcaccgtcctgagtgttgtacctgcaggttgctcacagcctctggagcccaagatagtctcccctttgggaggaggctctacagtggtccctggcgaagttgtgaagaggtctgccacgtctctgtgctcagtgtcctctctacatcctgtggcttgagcctgagcttgcccatattccctggctggatggagtggctaagccctgatatcgctctgcccagaagagatgagtggactcaaacttctccagccaggaagaggatcacgcatgccaaagtccagggtgcaggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttg

SEQ ID NO: 25822 - DNA, 2862 bp, Homo sapiens
ttctcggctgatctctctgggtaggtgccctctgggggcagtacccctgcctgagtggcacttcccctcctggctttgtttggtttggcctcgatttagaacagggttggcagaggcaggctgacttgcatttctggttttgggtttgttgctgcactttccccaaggggtgggcgggctctgactgacagtcaccactgggacaggcctgggccccaccctcaccacccaggaaaggggaaatgcggcccgctccccactcagtgccactctgtgccactccgtgccaggccctgagggcacccggttgctgcttccttccgtctttccccaaggactatcagagatgccagcgtgacccctgacacgtgtgtgcagcagcctgcagctgccccaagccatggctgaacactgactcccagctgtggggcttcaccattacagactccccagggcttcaaagacttctcagcttcgagcatggcttttggctgtcagggcagctgtacaatagtggatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 25823 - DNA, 4591 bp, Homo sapiens
aactttggctcagcctgtcttcatccactgtatcctgacacctctcctactccttctctttaatgtacagctgagactgggatacccttagactgaaaggaaggacacggctatgtagaaaagaattgactgaaggggaggagtactcgtgaaccccttgcttcagcctcccaatgttctgagagaggaggagccaggcgcagtggctcatgcctgtaatcccagcactttgggaggttgagatgggcagatcgcaaggtcaggagatcgagaccatcctggctaacaggtcacattcagacagcacacctttgcccaattttctttctggatctcaccgtcctgagtgttgtacctgcaggttgctcacagcctctggagcccaagatagtctcccctttgggaggaggctctacagtggtccctggcgaagttgtgaagaggtctgccacgtctctgtgctcagtgtcctctctacatcctgtggcttgagcctgagcttgcccatattccctggctggatggagtggctaagccctgatatcgctctgcccagaagagatgagtggactcaaacttctccagccaggaagaggatcacgcatgccaaagtccagggtgcaggtcagctgaggctgtccattgatgcccaggaccgggttctgctgcttcacattatagaaggtaaaggcctgatcagcaaacagcctggcacctgtgatccgtatgtgaagatttctttgatccctgaagatagtagactacgccaccagaagacgcagaccgttccagactgcagagacccggctttccacgagcacttcttctttcctgtccaagaggaggatgatcagaagcgtctcttggttactgtgtggaacagggccagccagtccagacagagtggactcattggctgcatgagctttggggtgaagtctctcctgactccagacaaggagatcagtggttggtactacctcctaggggagcacctgggccggaccaagcacttgaaggtggccaggcggcgactgcggccgctgagagacccgctgctgagaatgccaggaggtggggacactgagaatgggaagaaactaaagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 25824 - DNA, 2623 bp, Homo sapiens
agtgcgggctcccgctgctgggggagagctgggttttcatggggcggcagccgaggcaggacccgcagccatgaaccgcttcaatgggctctgcaaggtgtgctcggagcgccgctaccgccagatcaccatcccgaggggaaaggacggctttggcttcaccatctgctgcgactctccagttcgagtccaggccgtggattccgggggtccggcggaacgggcagggctgcagcagctggacacggtgctgcagctgaatgagaggcctgtggagcactggaaatgtgtggagctggcccacgagatccggagctgccccagtgagatcatcctactcgtgtggcgcatggtcccccaggtcaagccaggaccagatggcggggtcctgcggcgggcctcctgcaagtcgacacatgacctccagtcaccccccaacaaacgggagaagaactgcacccatggggtccaggcacggcctgagcagcgccacagctgccacctggtatgtgacagctctgatgggctgctgctcggcggctgggagcgctacaccgaggtggccaagcgcgggggccagcacaccctgcctgcactgtcccgtgccactgcccccaccgaccccaactacatcatcctggccccgctgaatcctgggagccagctgctccggcctgtgtaccaggaggataccatccccgaagaatcagggagtcccagtaaagggaagtcctacacaggcctggggaagaagtcccggctgatgaagacagtgcagaccatgaagggccacgggaactaccaaaactgcccggttgtgaggccgcatgccacgcactcaagctatggcacctacgtcaccctggcccccaaagtcctggtgttccctgtctttgttcagcctctagatctctgtaatcctgcccggaccctcctgctgtcagaggagctgctgctgtatgaagggaggaacaaggctgccgaggtgacactgtttgcctattcggacctgctgctcttcaccaaggaggacgagcctggccgctgcgacgtcctgaggaaccccctctacctccagagtgtgaagctgcaggaaggttcttcagaagacctgaaattctgcgtgctctatctagcagagaaggcagagtgcttattcactttggaagcgcactcgcaggagcagaagaagagagtgtgctggtgcctgtcggagaacatcgccaagcagcaacagctggcagcatcacccccggacagcaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttctt

SEQ ID NO: 25825 - DNA, 2759 bp, Homo sapiens
atcggctctgtcctgctctccacaggcctctgctgtgttgggagccactgccttcctcccctcccccaacctgtgggcccacagctcgccagctggcccttgaacccacttccctgcgcctctggctgcctcaatgtcactggggattagtgtgcatttgcggcttttggcggacactcccctcctggctgcagcctcaccctctggagcccagggatgggcttgggcctgggagccccctgaaccagggagcagccctgaccgtccgtttctctattttccctgacgtcagaaggcagagtgcttattcactttggaagcgcactcgcaggagcagaagaagagagtgtgctggtgcctgtcggagaacatcgccaagcagcaacagctggcagcatcacccccggacagcaagatgtttgagacggaggcagatgagaagagggagatggccttggaggaagggaaggggcctggtgccgaggattccccacccagcaaggagccctctcctggccaggagcttcctccaggacaagaccttccacccaacaaggactccccttctgggcaggaacccgctcccagccaagaaccactgtccagcaaagactcagctacctctgaaggatcccctccaggcccagatgctccgcccagcaaggatgtgccaccatgccaggaaccccctccagcccaagacctctcaccctgccaggacctacctgctggtcaagaacccctgcctcaccaggaccctctactcaccaaagacctccctgccatccaggaatcccccacccgggaccttccaccctgtcaagatctgcctcctagccaggtctccctgccagccaaggcccttactgaggacaccatgagctccggggacctactagcagctactggggacccacctgcggcccccaggccagccttcgtgatccctgaggtccggctggatagcacctacagccagaaggcaggggcagagcagggctgctcgggagatgaggaggatgcagaagaggccgaggaggtggaggagggggaggaaggggaggaggacgaggatgaggacaccagcgatgacaactacggagagcgcagtgaggccaagcgcagcagcatgatcgagacgggccagggggctgagggtggcctctcactgcgtgtgcagaactcgctgcggcgccggacgcacagcgagggcagcctgctgcaggagccccgagggccctgctttgcctccgacaccaccttgcactgctcagacggtgagggcgccgcctccacctggggcatgccttcgcccagcaccctcaagaaagagctgggccgcaatggtggctccatgcaccacctttccctcttcttcacaggacacaggaagatgagcggggctgacaccgttggggatgatgacgaagcctcccggaagagaaagagcaaaaacctagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttg

SEQ ID NO: 25826 - DNA, 2155 bp, Homo sapiens
attaaataattaaactttaaaatggtgtttttgtaagtttataggacttgtacttctgaagttattcaggcttaaaactactaagatgttggggtcctgctgtatattcatgactggatgtcgccaatgcaggtgactgaggctgagaggccggctggcaggagccattctctgggaggtgccctgtacagggggtctagggaaaagaggggcgaacatgagcaagaggcatttaactcctttcttgccagcagtttcacccagtgctgaattctgctgcctccttggggaccggcaaggctaaaaatggttcttggctaaaaatagccagtcctgccaccccggtggtgggcagtgcctcccctggctccctccttccctttcagcaatttgctgacttgtcccccaccccccaccactgtctccctgctgccatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgtctgagtcccagccccggcttgtgcctgggagtccagtcatcaggccaggattccagagagcgtgtgtggctgcagcctgcaccgttgctgcccgctgcccaggacgcggggtgggggacaggagccagagtggtgcctcctacagaccaatctgcggccccaaggtggggggccctacagagatgctccgaggcatgtacctcactcgcaacgggaacctgcagaggcgacacacgatgaaggaagccaaggacatgaagaacaagctggggatcttcagacggcggaatgagtcccctggagcccctcccgcgggcaaggcagacaaaatgatgaagtcattcaagcccacctcagaggaagccctcaagtggggcgagtccttggagaagctgctggttcacaaatacgggttagcagtgttccaagccttccttcgcactgagttcagtgaggagaatctggagttctggttggcttgtgaggacttcaagaaggtcaagtcacagtccaagatggcatccaaggccaagaagatctttgctgaatacatcgcgatccaggcatgcaaggaggtcaacctggactcctacacgcgggagcacaccaaggacaacctgcagagcgtcacgcggggctgcttcgacctggcacagaagcgcatcttcgggctcatggaaaaggactcgtaccctcgctttctccgttctgacctctacctggaccttattaaccagaagaagatgagtcccccgctttaggggccactggagtcgagctcagcgttcacaccaggcgggctgggtcccctgcccacctgcctccctgccccctgtgacggagggggcaagcaagcccccagaggctgtgtctctggacagacggatagacatacggaagcgaggcctggaccaagagaggcccaggctactggaggagtagaaggatgggccccgtggggtccccactgccccggtacgagggggcccaagaccctggcaggtcaggggccctggccaagccagatctggagctgctgctccctgctgcggagaccgcggaggcttcgcgttgaccaagttccttaaagaactggctgatggggcaggaggtccaggcctgggctctcgggccctcctagagggccattggagcttgcagctcagacccccactttgagttttatttatttaaatagtagttggatgcttggcacgtcgtcctgtaataggaaacccttgcctcatcagttttcctgatttacaagtgcaatattttagccaatgccttgggagaagctgccatgcaaaggtggacaccattctccagcttcaggggatatgctcgtcccgggcaccggtggcaggcagctggccttctggactaaggcagcctggggggacactgcagtctggctacacacagagatctggcaccccctgggtggagtgtccctcgggggctttgggaaagcatggcaccctcagaccacacagtagccaagttctggagcaaataaaaggcctgtgttatttcttgttcttga

SEQ ID NO: 25827 - DNA, 930 bp, Homo sapiens
agatcactcatgtgttcagtgattcaggttctgttgaagataccaaagatattcggttggtcaaaatgacgggcatataaaggcttctcaggtttctgagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaa

SEQ ID NO: 25828 - DNA, 2606 bp, Homo sapiens
aagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaat

SEQ ID NO: 25829 - DNA, 3200 bp, Homo sapiens
gacattgagtacattttttcccatatccctacttttcagaaggattttctctgctcgttcacttaacattgctgatgcgtcagtcttttcttcctcatctctttcaggggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 25830 - DNA, 3311 bp, Homo sapiens
agtttctgtatgctgccgggcttataactgtctgtcatccagctatttctctccaccttcttgtttgcataacaaccaaggcaacttccgcaaatcactgcgtggagacgatgatcctgccagctcccttttggaaatcgtgaggatcagatcttggaccatgtataatatgatgcttctaatccaaaagaggaaaggcattgggagtcagctcctaagggctggagaggcagagggagacagaggagctggtactgcagagcggtcgtctgattggctggacggtcgtagctgggctataaaagagacccctacaggcttagcaggaagacgctcagaggattctgacaatatctttaccggagaagaggcaaagtacgctcaaagccgaagccacagctcctcctgccgcatttctttcctgcttgcgaattccaagctgttaaataagatgtgcaaagggcttgcaggtctgccggcttcttgcttgaggagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattccagtccaattttcctaagtttctttgagggttccatgggagcaaatatctaaataatggcctggtaggtctggattttcaaagattgttggcagtttcctcctcccaacagttttacctcgggatggttggttagtgcatgtcacatgacatccacatgcacatgtattctgttggccagcacgttctccagactctagatgtttagatgaggttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacacacacacttttgcaagagtgatgggaaagaccctaggtgctcataactagagtatgtgtatgtacttacatgggtgttttgatctctgttctttcatactacatttgaacagggcaaaatgaactaactgccatgtaggctaagaaagaaatgctaacctgtggaaagttggttttgtaaaattccatggatcttgctggagaagcatccaaggaacttcatgcttgatttgaccactgacagcctccaccttgagcactattctaaggagcaaataccttagctcccttgagctggttttctctgatggcacttttgagctcctaagctgccagccttcccttcttttcctgggtgctcagggcatgcttattagcagctgggttggtatggagttggcagacaggatgttcaacttaatgaagaaatacagctaaggccttgccagcaacacctgccgtaagttactggctgagtgagggcatagaagttaaaggttactgtttttatcctctatccttttttcctttcctgatcaaggtgctcttctcattttttcctgagaaccttagccatcagatgaggctccttagtttattgtggttggttgttttttctttataatggctctgggctatatgcctatatttataaaccagcagcaggggaaagattatattttataagagggaacaaattttcacaatttgaaaagcccacataagttttctcttttaaggtagaatcttgttaatttcattccaaacatcggggctaacagagactggaggcatttctttttaggctctgagactaaatgagaggaaaagaaaagaaaaaaaaaatgattgtctaaccaattgtgagaattactgtttgaaacttttcaaggcacattgaaatacttgaaaacttctcatttatgttatttatgatgttattttgtacgtgttattattattatattgttttataaatggaggtacaggatatcacctgaattattaatgaatgcccaggaagtaattttcttctcattcttctaaaactactgcctttcaaagtgcacacacacgcgtccacatacactgcattcgttgctccagtataaattacatgcatgagcacctttctggcttttaagccaatataatgggctgcaaaatgaagacaccagagtgtatgcatacaaatctcactgtattaaagatgcaggttttctaattgtacccttcttgtctctctggcaatcttgcccttaatatccctggagttcctcatcagtgtcattttctgttatacacagttccacaattttgtctctagttgacttcaaatgtgtaactttattggtcttgccctattataattgtcatgactttcagattgtatctgaactcacagactgctgtcttactaataggtctggaaggtcacgctgaatgagaagtaaattattttatgtaatacatttttgagtgtgtttttcagttgtatttccctgttatttcatcactatttccaatggtgagcttgcctgctcatgctccctggacagaatactccttccttttgcatgcctgtttctatcatgtgcttgataggcctcaaagctaatgcttccagtgaaacacacgcatcttaataataagggtaaataaacgctccatatgaaacta

SEQ ID NO: 25831 - DNA, 817 bp, Homo sapiens
aagacgctcagaggattctgacaatatctttaccggagaagaggcaaatgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaaggattcctaccgccgcttcctcaagtctcgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtggg

SEQ ID NO: 25832 - DNA, 551 bp, Homo sapiens
aaactgaagggtcagaattccagttgtggatgaaggaaatggtgttatgactgcctcaaggttttgtagcaagtcatagggaaccaagaggaatcttgttttcctcagagtgcaaaagatatgaaacatcggctaggtttcctgctgcaaaaatctgattcctgtgaacacaattcttcccacaacaagaaggacaaagtggttatttgccagagagtgagccaagaggaagtcaagaaatgggctgaatcactggaaaacctgattagtcatgaatgtgggctggcagctttcaaagctttcttgaagtctgaatatagtgaggagaatattgacttctggatcagctgtgaagagtacaagaaaatcaaatcaccatctaaactaagtcccaaggccaaaaagatctataatgaattcatctcagtccaggcaaccaaagaggtgaacctggattcttgcaccagggaagagacaagccggaacatgctagagcctacaataacctgctttgatgaggcccagaagaagattttcaacctgatggagaa

SEQ ID NO: 25833 - DNA, 5862 bp, Homo sapiens
gagtgttgtgataagagcagatgaaagccttatgccacagtagtgcctgtagcagagaaaggattccctcctccacctcagggcccactgctgctgctctccagcctgcagtttcctctaaggctctggattggctggaagagcaacagagggctgggaaagagcttctatatatacctcaggaggaaaggcatcccagacagttttgaagttttcaaagactggctctgctgttaagaagttgtacttaaagcggaggagctaagccacctgccaaaatgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgtaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctacaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctatataa

SEQ ID NO: 25834 - DNA, 934 bp, Homo sapiens
agaagtgtctgacaaaacaaagaaacaaaacctcagtgaaaaatgtgcgcaagaaacatttcacaggatattctcatcttacagatgcacagtgctcattggcatatcaatggcaaatatgaggaaaagagtaacctgatgttctgggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaagg

SEQ ID NO: 25835 - DNA, 373 bp, Homo sapiens
atgtgcaaaggacttgcagctttgccccactcatgcctggaaagatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtag

SEQ ID NO: 25836 - DNA, 1362 bp, Homo sapiens
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctga

SEQ ID NO: 25837 - DNA, 1564 bp, Homo sapiens
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaagg

SEQ ID NO: 25838 - DNA, 1419 bp, Homo sapiens
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctga

SEQ ID NO: 25839 - DNA, 1497 bp, Homo sapiens
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgtgtctgcagcttctcttctagggatgaaaatgcaaaaaagagcaagcggctccctctgcagaaggtgcacccttg

SEQ ID NO: 25840 - DNA, 1476 bp, Homo sapiens
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggatgaaaatgcaaaaaagagcaagcggctccctctgcagaaggtgcacccttg

SEQ ID NO: 25841 - DNA, 1497 bp, Homo sapiens
atggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgcttctcttctagggatgaaaatgcaaaaaagagcaagcggctccctctgcagaaggtgcacccttgatcgcccag

SEQ ID NO: 25842 - DNA, 1828 bp, Homo sapiens
cgttgcaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaat

SEQ ID NO: 25843 - DNA, 1480 bp, Homo sapiens
attgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaagg

SEQ ID NO: 25844 - DNA, 1103 bp, Homo sapiens
aaaacactgactatgaaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgctttggttgttgtttcctttgggaaagcggccg

SEQ ID NO: 25845 - DNA, 2005 bp, Homo sapiens
gcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttccta

SEQ ID NO: 25846 - DNA, 3105 bp, Homo sapiens
gactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagc

SEQ ID NO: 25847 - DNA, 1110 bp, Homo sapiens
aaaacactgactatgaaggaggaagacattgaagaaggaaagccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgttgtattccaacactccactcgctaagaggccctgatccc

SEQ ID NO: 25848 - DNA, 1764 bp, Homo sapiens
agccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagggaaagtcgctggcgggcaagcgcctcacgggcctgatgcagtcctcctga

SEQ ID NO: 25849 - DNA, 1689 bp, Homo sapiens
caccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagccagaaagtgagcaaggtcgtagaacttccctagaaaagttcactcgcagtgtgggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgaggg

SEQ ID NO: 25850 - DNA, 2111 bp, Homo sapiens
gttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcagtgtgagtgaagacactcaggatggctcaaggatccggggatcaaagagcagtgggggttgctgacccagaggagagttctccaaacatgatcgtttactgcaaaattgaagacatcattacaaagatgcaagatgacaagacagggggtgtgcccatcagaacagtcaagagctttctctccaaaatccccagtgtcgtcacaggtactgacattgtgcagtggcttatgaagaacctttccattgaggacccagttgaagcaatacacttggggagccttatcgctgcccagggctacatctttccaatctcagaccatgttctcaccatgaaggatgatggcaccttttatcgtttccaggctccgtacttctggccttcgaactgctgggaacctgaaaacactgactatgccatctatctctgtaagaggacaatgcaaaataaagcaaggctggaactggcagattatgaagcagaaaacttagcaagactccagagggcctttgcgaggaagtgggaattcatctttatgcaagcagaagcacaagtaaagattgaccggaaaaaagacaagacagaaaggaaaattttggatagtcaagaacgagccttttgggatgtccacaggcctgtgccaggctgtgtgaacacaacagaaatggatatccgaaaatgtcgacgtttgaagaatccacaaaaggttaaaaagtccgtgtatggcgtgactgaagagtcccaggcacagagcccggtgcatgtactcagccaaccaatcaggaaaacaacaaaagaggacatccggaaacagataacatttttgaacgcacagatcgacagacattgtttgaaaatgtccaaagtggctgaaagtttaattgcctacacggaacaatatgtggaatatgaccctttgataacaccagctgagccatccaacccttggatcagcgatgacgttgctttgtgggacatagagatgagcaaagagcccagccaacagcgagtaaaaagatggggcttctctttcgatgagatattgaaggaccaggtggggcgggaccagtttctacgattcctggagtccgaattcagttcagaaaacctcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggagcacatctacaagctgatgaagagtgacagctatgcccgcttcctccggtcaaatgcttaccaggatttgctgctggccaagaagaagaaagtgagcaaggtcgtagaacttccctagaaaagttcactcgcagtgtgtgctgctggcgcagagtcagaatggccgctgcatttcacccccgaggtggcttccttccagcagtggggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaa

SEQ ID NO: 25851 - DNA, 1822 bp, Homo sapiens
tctttgaaagcagtcacacagcaggttaacaccctgcctccatgctgctcagtgaaacgttgcatttatggcttcccaaggaagggggaatctttatgtaggtttacaaagctgcttccgtgaaccgcagccatgagaaggttcacggataaattatgtctggataaagataaaaacagctgaatgcatgtacatgatcacgttttcagtctagaacaccaatcctatttttacttggagttaaaatttttttctcttgtggaaatgatgactcagaaaaatggaatattttggaatacaaccacagaagtcacttttactttccagcctcctattctcactcctttgggatcccatgaactgagaggggatgagactatacaaagaaaacactgccactcatagctacgcacctaaattcagcccgaagcagagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggtcatcgttgcagaaagataaaaga

SEQ ID NO: 25852 - DNA, 1980 bp, Homo sapiens
atggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 25853 - DNA, 1410 bp, Homo sapiens
atggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaaggggaaatctctcacgtccaagaggttaacaagccttgctcagtcttactaa

SEQ ID NO: 25854 - DNA, 2206 bp, Homo sapiens
tgaccttggcggaggagggcacactgataattcttgtatcttgagagtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 25855 - DNA, 2295 bp, Homo sapiens
gggcggcggcgaggcgagggtggcggtcgcctgagcagctagagccggggcggcgcggaatccgcatccgccgcgagtgtgatgaagctaccctgcctcgctgctccgcttgccgccagctgacaccgcctgcacccagcccgcccgggaggggagacgccgcggggccgtgaccttggcggaggagggcacactgataattcttgtatcttgagagtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 25856 - DNA, 2494 bp, Homo sapiens
gtcgcgcgcacgggccgggcgtctcgactcccgcgcgcgctcggctggtcccagtccccgggagaagaagcggaggagggagagagccagcgaggcggcccaggggagcgggcgcgagtggcggctgccggagccgcctgtgcacgggcggcggcgaggcgagggtggcggtcgcctgagcagctagagccggggcggcgcggaatccgcatccgccgcgagtgtgatgaagctaccctgcctcgctgctccgcttgccgccagctgacaccgcctgcacccagcccgcccgggaggggagacgccgcggggccgtgaccttggcggaggagggcacactgataattcttgtatcttgagagtggaccaagttttgggtgacatggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 25857 - DNA, 1275 bp, Homo sapiens
atggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatga

SEQ ID NO: 25858 - DNA, 1488 bp, Homo sapiens
atggcccaggggaataattatgggcagaccagcaacggggtggccgatgaatcacccaacatgctggtgtacagaaagatggaagacgtcatagcacggatgcaagatgaaaaaaatggaattcctattcgtacggtcaaaagctttctttccaagatacctagcgtcttctctggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtgggcagaaacatccctattttcccatgccataaaaactgtacaccaacactgagggccagcactaacctgttatga

SEQ ID NO: 25859 - DNA, 1686 bp, Homo sapiens
caagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagtctggaaactcaatggatcgcagaacatcttttgaaaaatttgcacagaatgtgggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctccgttaatgtttctcgcatttatttttataccatatttaaagaagaaacaccttttactccaaatgtattaaagttgatcccttctctgtaaatttgtgtatgtttatattgttgttttatctttcattaaaagatgcagaatctc

SEQ ID NO: 25860 - DNA, 2209 bp, Homo sapiens
agcttctgtagtgttgccgaggatgtttggactcttgtttctgatgctggcatgaagatggggagggggacacaggtgaaatagggaaactgtgctagatttgcacctgggatgttcctctttgtcatgacggagatggaagacgtcatagcacggatgcaagatgaaaaaaatggaattcctattcgtacggtcaaaagctttctttccaagatacctagcgtcttctctggacaccatcaacctggagggaccggaaaacacgcatcacagggagtgagccactctgtagttgagaagtcaatttcatactagagctgaatggttttacggtccgcagctgtatccaagaagggcgagggggaaaattccatgcctcactggtaccaggttcagacattgttcaatggttgataaagaacttaactatagaagatccagtggaggcgctccatttgggaacattaatggctgcccacggctacttctttccaatctcagatcatgtcctcacactcaaggatgatggcaccttttaccggtttcaaaccccctatttttggccatcaaattgttgggagccggaaaacacagattatgccgtttacctctgcaagagaacaatgcaaaacaaggcacgactggagctcgcagactatgaggctgagagcctggccaggctgcagagagcatttgcccggaagtgggagttcattttcatgcaagcagaagcacaagcaaaagtggacaagaagagagacaagattgaaaggaagatccttgacagccaagagagagcgttctgggacgtgcacaggcccgtgcctggatgtgtaaatacaactgaagtggacattaagaagtcatccagaatgagaaacccccacaaaacacggaagtctgtctatggtttacaaaatgatattagaagtcacagtcctacccacacacccacaccagaaactaaacctccaacagaagatgagttacaacaacagataaaatattggcaaatacagttagatagacatcggttaaaaatgtcaaaagtcgctgacagtctactaagttacacggaacagtatttagaatacgacccgtttcttttgccacctgacccttctaacccatggctgtccgatgacaccactttctgggaacttgaggcaagcaaagaaccgagccagcagagggtaaaacgatggggttttggcatggacgaggcattgaaagacccagttgggagagaacagttccttaaatttctagagtcagaattcagctcggaaaatttaagattctggctggcagtggaggacctgaaaaagaggcctattaaagaagtaccctcaagagttcaggaaatatggcaagagtttctggctcccggagcccccagtgctattaacttggattccaagagttatgacaaaaccacacagaacgtgaaggaacctggacgatacacatttgaagatgctcaggagcacatttacaaactgatgaaaagtgattcatacccacgttttataagatccagtgcctatcaggagcttctacaggcaaagaaaaagggcagaaacatccctattttcccatgccataaaaactgtacaccaacactgagggccagcactaacctgttatgaaaagaggggaaatctctcacgtccaagaggttaacaagccttgctcagtcttactaaacggatcatcttgtagcatgaatgcagactggagtcactgcacacactttgtagctcaatgttgtgacctggagcagaggacattagaacaagatgttgcatgagcaaaggacctaaattgttatttttgtgtgtacattccatctccaatggactcttccgtctcaatgcctccattccaaactgttgtctgctttctttctccttctactatgctggatctgtgtctcttcctttttaacaagttcaagtgaagtaaaaccttttctttttttccttctttctctctctctctctctcaaagcttcagttagacacacagttcactgaaaattcagtcagtcaaaaactggaagaactgtaaaagaaaaaagtatatatcaataagtatacatgtggcttcacatttattaaacaataaattccgcacagaaagtttcatttcaccaatgtgtcacagtcagaaacaaactcatgtcttcgtctgttgtctgtacattctc

SEQ ID NO: 25861 - DNA, 4160 bp, Homo sapiens
agccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagcgcttccccggctctccttcaagctgaaggttaccgacccgcgcagccagccccagcactgtgagctgcgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgaaaaatcaagatgacagcagccttctgaatctaactccctaccccctggtgagaagacggaagagaaggttctttgggctgtgttgtctcatctcaagctaggtggctcctcctggaaacccactgagaacatctgaaaaaaaatcacaaaacccgaggacctccagacagctgaaccacacagttattggtttttgactatgttttctatgcttccttattacttttatctgcctccccctgcccttttaaatgattttacacttgaaagcagctgccgtcaagaaaaaaaagaacagattcaaaaaccaggctgtttttaaaagggaattttaaagctgacattgtgcatgtctgctccaaaccacgccatgacagatgcaagaattatgatttttaaattatttaaaggttttttaaatgtattatacagaggaaaaatatttcacatataatagtatatctatagctcttgctgatctcatgttaaaatttatcgtatatgaaagaagtctttaaacatagaaatctatttaaaactgaaaaactgtgttcaaaaatccaatctatcaatatcattagaaataatattataagcaaacatataccacctcacctattgctttctctgcactcatttacatttagtcttccattctgtcagaatctaagagcttcaacataaaagtatcttaatttataaagcaacaaaaaccacatatgaaaagtactaaaattttgtaaatacacaataatcctaataccttcgtacaaatgcatatgggcaactaatttctttttgatccaatgatgtctttttcagcttcttggagaatgaagtaatccagttaggaaatggtgtagtaacatatacaattgccctcaaatgtaaaatcaaatattattacattttgttctaattgaaatctgaagcatggtgtctgcacatcagcatagtgttaaatcttatagggcatgctggaattagctcagattataaaaatatttaacattttacattgttaataaagttttttagttaagctaagcttgtctcattttagatgactatgcagataagatttttccaacgtgtacttggtgtcttgtcttatgcttagactcttgaaagcaggacacattaagcaatactatattttagaaaggaggaagccacatgctttgtttttctgctcacagctttgttgtgatcttccttcactaaacttgtaacatggtacaaattttgttataccgtctcctgttcttcctttggcccatttcccagacagaatttcccatgggttgagagatcaagtctttgcactttttttcttgttttccatagtctgaaaaaccttcaagtcagacaggaggcaccagtgtccagtacaatagaaggatgagctagatgccgataagtggtttatccaagacacatctttagtcccaaccctgttctttaccaatacttatgtgcacaggcatttatatgtataccaatatttttacctaaaaactaaatatattaaggccttttgctttagtgaagatgaactactgtaataattattgtattaggttgaattatatgaaatttcctatatgtgactgttttgacctacaaaatggcaatttcttatagttcaccctaatatccaatgtggaaattatacttggaattgtcttctagctcttttgattgaaagtgaaagaattaaagggttggaagagaacgttatacaggtctctatttagatcataccagctggtttttggccttattctttgaatctagagttgtgttccaaggaaccagtaattaatgcatggttataggtatacctggcttcaaaaaaaagaagtagccgtggaaagctatatgagaaaatcacaattttctgaatcaaatatttgtaaaacaatttggctatttaaagactcttagggtaaatactccctggaaaagcaagcaatccagacttatctggtctgcaaaccttgatttcagcttaatatcctttcctgaatctaattcattttcacccactaaggtcatttcatttaagatccattgtttttgaaattttgaagtagcccagtttggcagctctcagcacctgcctctgccctctcctatacttcaactatattgaactctagcttcaatctagttcctactaatccatgcaaaagttattaactgataagcccaatcttgttcagcacgttcttctaaatgcctgacctaaataacttctgcttggttaacttgtgttcattctcaccttagcctcagtgtgaaagtaacacttaccttctgtgcaattgtcctttgtacaactgaagactgttaataaattcaggtctcacctccatgtctgaaaaggctatagtagctattcatggagatgggaatttgtctaattacctagccagagtttgcatatttaaggtaatatattcagctaccgtatcttttattcatagtgcctgttttccagcctttgatcagttttgtagttcccgtggataaactccaagatctaaagatcctctttcagtagcatatactaaaattaagtttagtgctcaaaaccctggtaacctacactggcccaaggttacagtaggtaattcaccgtctcacattagacaggccaatgcatcccttaggagctgccccactctcctctcacctaccaaaggattttctcaggtgtggttccaagcgataaagttctactgtctcggcttcctgctggtaattcgctttcagattagcaataacactgagctgatctctagggttaagaagagaacattgaactcattttgtcgcatgtacccacaggcttgaaacagaaaatgatgtaaacttttgtggcatacattcacccattttcccaccatatctttactatcctgtgttgatttttttttcaaattacaaagacaatacatgttctttgtgggaaatctgaaaaatactaccaaatagaaaataaaaatcacctgaattccaccacgaccacattgtttaaaaccacatttctgggttttaaatcagtcagtggctgggcccaaaggcacttttgggtaagataagtgaagaaatgcccacaaggccaaggtgtcacttaaaaaaacaaacaaaaaaaa

SEQ ID NO: 25862 - DNA, 2522 bp, Homo sapiens
gattggctggcgcggattccagctgctttccaagtcagcggcgcctagtgagagtcaggggggcccggcccgcgccctccccgcccagccgcctccccgtcgacgcccagggctggggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaaggtaaaccagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttgg

SEQ ID NO: 25863 - DNA, 2513 bp, Homo sapiens
gattggctggcgcggattccagctgctttccaagtcagcggcgcctagtgagagtcaggggggcccggcccgcgccctccccgcccagccgcctccccgtcgacgcccagggctggggcgagccaggctgcctttcgaacttggggggcttctcctcttgtctcccactggtgctctggctgtgaatccatccaggggccaggatgacaatccgacaccaaggccagcagtacaggccgaggatggcatttctccaaaagattgaagcgctcgtgaaggacatgcagaacccagagacaggggtccgaatgcagaaccagagggtcctggtcaccagcgttcctcatgccatgacaggaagtgatgttctgcaatggatcgtccagcggctttggatctccagtctggaggcacagaacttgggcaactttattgtcaggtatggctacatttaccccctgcaagaccccaagaatctcattctcaagcctgatggcagcctctacagatttcagacaccgtatttctggcccacccagcagtggccagctgaagataccgattacgccatctatctggccaagcgaaatatcaaaaagaaagggattttggaagaatatgaaaaggaaaattacaatttcttgaaccaaaaaatgaactataagtgggactttgtcattatgcaggccaaagagcagtacagggctggaaaggagaggaacaaagcagacagatatgccctggactgccaggagaaggcatactggctggtgcaccgatgccctcctggaatggacaatgtgctggactacggcctggaccgagtgaccaatccgaatgaagtcaagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcacagtgaaggggctgaagcacccccaccgctatgtgctggacgccgcacaaacccacatttacatgctcatgaagaaggattcttatgctcgctatttaaaatctccgatctataaggacatgctggccaaagctattgaacctcaggaaaccaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttgg

SEQ ID NO: 25864 - DNA, 6856 bp, Homo sapiens
cggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgccgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagactccg

SEQ ID NO: 25865 - DNA, 2461 bp, Homo sapiens
aggccgcggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagcgtgagtatccccgccctcctccccagagtgatgtgaacctgccggcccttctggggatgccgagccctgcgtttccagcctgccctttctccagcctcgctccctctccaggcaccgccgttcccttcctctcttctggggtaaagtgggacgcgcccgcctcggcagccacctctgggtcgtgggggctgtcacctacctgtcctgtccctggccttcccctg

SEQ ID NO: 25866 - DNA, 6382 bp, Homo sapiens
cggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaggtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagcgagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgccgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgcgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactggcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagactccg

SEQ ID NO: 25867 - DNA, 2578 bp, Homo sapiens
gaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctg

SEQ ID NO: 25868 - DNA, 4376 bp, Homo sapiens
acagttgccccggtgagggaaacggaggcgccatagccacggtagtcgtggcgaccaagcaacccggcaacgcgagtcaacaacaacaaccgcccggccgacccccacccccaccccccaggcccggcccggggaccccagcacgtcccgtccccttcccaacatcgactccgagacctccgaaaagcgtttccgcagacagaagtggggagaagcggaggaattaaaaaaaaaaaaaagccttatttattatcattttccccaccgttggcatggcaacacaggcgtatactgagctacaggcagccccgccaccatcccagccgccacaggccccgccacaagcccagccccagccgccaccgccaccacccccagcggcaccccagcccccgcagccacccaccgctgctgccacccctcagccccaatatgtcaccgagctgcagagcccccagccccaggcacagccaccgggtggccagaagcagtacgtgacggagctcccggctgtacccgcaccctcgcagccaaccggtgcacccaccccttcgcctgcaccccagcagtacatcgtggtcactgtctctgaaggtgccatgcgggccagcgagacagtgtcggaggccagccccggctccaccgccagccagaccggcgttcctactcaggtggttcagcaggtgcagggcacccagcagcggctgctggtccagacgagcgtgcaggccaagccaggccacgtgtcgcccctccagctgaccaacatccaagtgccccagcaggctcttcccacgcagcgtctggtggtgcagagcgcagccccaggcagcaaaggtggccaggtctccctgacggtccatggtacccagcaggtgcactcgcccccagagcagtcgccggtgcaggccaacagctcttccagcaagacagccggggcccccacgggcacagtgccacagcagctgcaggtccacggcgtccagcagagtgtccccgtcacccaagagagatctgtggtccaggccactccacaagcgcccaaacccggcccggtgcagccgctgaccgtgcagggcctccagccagtccacgtggctcaagaggtgcagcagctccagcaggtgcccgtcccacacgtgtactccagccaggtgcagtatgtggagggcggcgatgccagctacacggccagtgccatccgttccagcacctactcctatcccgagacgccgctgtacacgcagacggcaagcaccagctactacgaggccgcaggcacggccacccaggtcagcacccccgccacctcccaggcggtggccagcagtggctccatgcccatgtacgtgtccggcagccaggtcgtcgccagctccaccagcactggggctggggccagcaacagcagcggaggtggtggcagtggtggtggcggcggcggcgggggaggcggtggcgggggtggcagtggcagcaccggaggcggcggcagcggagcaggcacctacgtgatccaaggcggctacatgctgggcagtgccagccagtcttactctcacaccacccgtgcctcgccagccacggtccagtggctcctggacaactatgagacggctgagggcgtgagtctgccacggagcaccctctactgccactacttactgcactgccaggagcagaagctggagcccgtcaacgccgcctccttcggcaagctcatccgctccgtcttcatgggcctgcgaacccgccgtctgggcaccaggggcaactccaagtaccactactatggcctgcgcatcaaggccagctcacccctgctgcggctgatggaggaccagcagcacatggccatgcggggccagcccttctcgcagaagcagaggctcaagcccatccagaagatggaaggcatgaccaacggcgtggcggtggggcagcagccgagcacggggctgtcggacatcagcgcccaggtgcagcagtaccagcaatttttggatgcctctcggagcctccctgacttcacagagctcgacctccagggcaaggtgctgcctgagggcgtcgggcccggggacatcaaagccttccaggtcctgtaccgggaacactgtgaggccattgtcgacgtcatggtgaacctgcagttcaccctggtggagacgctgtggaagaccttctggaggtacaacctcagccagcccagtgaggcgccaccgctggctgtacatgacgaggccgagaagcgactgcccaaagccatcctggtgctcctctccaagttcgagcccgtgctccaatggaccaagcactgtgacaacgtgctgtaccagggcctggtggaaatcctcattcccgacgtgctgcggcccatccccagtgccttgacccaagcgatccggaactttgccaagagcctggagagctggctcacccacgccatggtcaacatccccgaggagatgctgcgggtgaaggtggccgcggctggcgccttcgcgcagacactgcggcgctacacgtcgctcaaccacctggcgcaggcggcgcgcgctgtgctgcagaacaccgcacagatcaaccagatgctgagcgacctcaaccgcgtggacttcgccaacgtgcaggagcaggcctcgtgggtgtgccgctgcgaggaccgcgtggtgcagcggctggagcaggacttcaaggtgacgctgcagcagcagaactcgctggagcagtgggcggcctggctggacggcgtggtgagccaggtgctcaagccctaccagggcagcgccggcttccccaaggccgccaagctcttcctcctcaagtggtccttctacagctccatggtgatccgggacctgaccctgcgcagcgccgccagcttcggttccttccacctcatccggctgctctacgacgagtacatgtactacctgatcgagcaccgcgtagcccaggccaagggcgagacccccatcgccgtcatgggcgagttcgccaatctggccacctccctgaaccccctggaccccgacaaagacgaggaggaagaagaggaggaggagagcgaggacgagctgccgcaggacatctcactggcggctggcggcgagtcacccgcgctgggcccggagaccctggagccgccggccaagctggcgcggactgacgcgcgcggcctcttcgtgcaggcgctgccctccagctaagcccttggcctccccgccccacccgcccccgccacccctccacgccagggtccctcaaagcttctgtggcttcgtggtcactgctccagcctcagccagggcagggagggggactccgagacagggaagaccggggccctcctcccttatggggccggcacaatcagtgggctgggcggagccgcagctgcaaactctgacacaaaagacgtgccttaaggaacccgccgcgtgcccaggtgccccgcggggcatccagctcggccccttggccgcccccctcccaggccccagcgtcttctccccagccccgtcctcccaccaccccagggggcaggcaggcaggccccctcccgtgcgaaactgttaacttattcagctcgctggctttgcacagcctgtcctgggcccagccctgagccccgggccggcgcaggtgggcgtcacctggggactccccactgtcagcagcagccccgggacaccctacccccagcaaccccactgcttccccttcttggtattaagtgcaattaaagccgtgggtgtcgcatcttctccagcgctgggccctcccttgcccccaagctcaagaagggggcactgcccggcccggctgtgaggagggcggcagggggcacggcctccagcttccaaagagcagcgagccgcggagccggggagtgcccacagaccccagcccccgcgcccccgccctccgccgctggtttgtaatggaaccttttctgtgcccctatcttcccggagaccacgcttctcctccgtgccgtgcgacccccaccccatgactattgtgcgattcgtgagcgccgcccgagcggagttggtaacttgttgggtttttttccaaccatcatggccttatctgttccagttttctcagtgttttcagcctgtgagatagatgtttatggcaagaaaaaggaaaaaaaaatggaaatctgacctattgtataaaaatcactattttgtgtgctccgcgtgctatagcttttggggcggccctgcccagtccccgtgcccacggggctccctctcccggtggtgaaagtgtccacacgtgtggtagtctagtgtgccgagctgttttctacctttttgtagtctttcttaaaacaataaattccgctgtgatatttgcct

SEQ ID NO: 25869 - DNA, 4112 bp, Homo sapiens
gcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgcctta

SEQ ID NO: 25870 - DNA, 4037 bp, Homo sapiens
gcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgcctta

SEQ ID NO: 25871 - DNA, 3576 bp, Homo sapiens
ccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 25872 - DNA, 2459 bp, Homo sapiens
cgtgtatctaggcagatcgcggctgttacaaccattcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaaccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttat

SEQ ID NO: 25873 - DNA, 2056 bp, Homo sapiens
ttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctggccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaagga

SEQ ID NO: 25874 - DNA, 562 bp, Homo sapiens
agtgaaggtggctacgaggtagtttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcg

SEQ ID NO: 25875 - DNA, 902 bp, Homo sapiens
agcgcatgagttccgctaccccgccccacccccgctccactttgcagaaaccggggattgaatggagggggaagggaaggagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcct

SEQ ID NO: 25876 - DNA, 585 bp, Homo sapiens
agtgaaggtggctacgaggtagtttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagt

SEQ ID NO: 25877 - DNA, 545 bp, Homo sapiens
agcagcgggggaagtcgtggcgagattaagtaatgagaacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatcc

SEQ ID NO: 25878 - DNA, 597 bp, Homo sapiens
ttcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctggccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacac

SEQ ID NO: 25879 - DNA, 903 bp, Homo sapiens
aaccggggattgaatggagggggaagggaaggaggtgggggcgcgcctcaggatgggctgttgtgggagatgacgtaggggccggcgacgtggggagggggagcagcgggggaagtcgtggcgagattaagtaatgagaacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgaga

SEQ ID NO: 25880 - DNA, 2100 bp, Homo sapiens
attcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaaggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctg

SEQ ID NO: 25881 - DNA, 2355 bp, Homo sapiens
gcagcagtgaccaatgacagagcaggccgcccgtgtatctaggcagatcgcggctgttacaaccattcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggctcgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgacctta

SEQ ID NO: 25882 - DNA, 537 bp, Homo sapiens
ttttccagatttaggagacttcagaaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataagga

SEQ ID NO: 25883 - DNA, 3460 bp, Homo sapiens
tccggcggccaggaggatggccaaggtcccggagctggaagacaccttcctgcaggcgcagcctgcgccccaactgtccccggggatccaggaagactgctgtgtgcagctcctgggcaagggcttgctagtctatccggaagaaacagtgtacctggcggccgaagggcagcccgggggcgagcagggcggcggggagaaaggcgaagacccggagctgccgggggcagtgaaatcagaaatgcacttaaacaatggtaacttttcctctgaagaagaggacgccgacaaccacgacagcaaaaccaaagcagcggatcaatacctgtctcagaagaaaaccatcacgcagattgtgaaggataaaaagaagcagacacagctcacgctgcagtggcttgaagagaattacattgtatgtgaaggagtttgcttaccacggtgcattctttatgcacactacttagatttctgtaggaaagagaaattagagccagcctgtgcggccacctttggaaagacaattcgccagaagtttcccctcctaacaacaaggcggcttggaacaagaggccattcaaagtatcattactatgggattggcatcaaagagagcagtgcatattaccactccgtttattctggaaagggcttgacaaggttttctggaagcaagctaaagaatgagggtggcttcactcgtaaatattcgcttagctcaaaaactggaacacttcttccagaattccccagcgctcaacaccttgtataccaaggatgcatttctaaggacaaggttgatacgctcataatgatgtacaaaactcactgccagtgtatcctggacaatgcaattaatggaaactttgaagagatccagcattttttattacacttttggcaaggaatgcctgaccatctccttcccctgctcgaaaatcctgttatcattgatattttctgtgtttgtgactcaattctttataaggttcttacagatgtactcattcctgcaacaatgcaagaaatgcctgaaagcttattagcagacataagaaattttgctaaaaattgggaacagtgggttgtttcatccttggaaaacttgccagaagctctaactgacaagaaaatacctattgtgcgaagatttgtatcttctctgaaacgacaaacatctttcttacatcttgcccagattgccagaccagctctctttgaccagcatgtcgttaattctatggtgtctgatattgaaagggttgatttgaacagcattggctctcaagcccttcttaccatttcaggcagcacagacactgaatctggtatctacactgaacatgactctatcactgtgttccaagaactgaaggatctccttaagaagaatgccactgtggaggcttttattgaatggttggatactgtggtagaacagagagttattaagaccagcaaacaaaatggaaggtcattaaagaagagagctcaagactttctgttaaagtggagtttttttggtgctcgagtaatgcataatctcaccttgaacaatgcatccagttttggttcttttcatttgattcgaatgcttctcgatgaatacattctcctggccatggagacccagtttaataatgacaaagagcaggagttacagaatttattggacaagtatatgaagaattcagatgcgagtaaagctgctttcactgcttctccgagttcatgctttctggccaaccgtaataaagggagcatggtttccagcgacgctgtgaagaatgaaagccacgtggagacaacctatctccctctgccatccagtcaacctggaggcctaggccctgctctgcaccagttccctgctgggaacacagacaacatgccgctcacaggtcaaatggagctttcacagattgctggtcatctgatgacaccacccatttctccagccatggcaagccgaggaagtgtcattaaccaaggaccaatggcagggaggcccccaagtgtgggcccagtactgtcagctccatcacactgctccacatacccagagcccatttatcccactctccctcaagccaatcatgacttttatagcaccagctctaactaccagactgtgtttagggcacagccccactccacatcaggactctatcctcatcacaccgagcatggtcgatgcatggcttggactgaacagcagctttcaagagacttcttcagtggcagctgtgcggggtctccatataactcccggccaccgtctagctatggcccatccctgcaagcccaggattcacacaatatgcagtttttaaatacaggaagcttcaatttcttgagcaacacaggagctgccagctgccaaggagcaacactgcctcctaattcaccaaatggatactatggaagcaacataaactacccagagtctcacaggctcggatcaatggtgaatcagcacgtttctgtcatcagcagcattcgttcactgcccccctacagtgacatccacgatccacttaacattttagatgacagtggtagaaaacagaccagctcgttttacacagacacatcatctccagttgcatgtcgaactccagtcctagcttccagtttgcaaaccccaattccttcttcctcatcccaatgtatgtatggaacttccaaccagtatccagctcaagaaaccctggactcccatggaacaagcagtagagaaatggtgtcctctttaccacctatcaacactgtgttcatgggaacagcagctggaggcacttaaaccaccaatgtgggagggggtgctaaaactttaaaaaaaatctctactgtgcaaatatcattattcactcagacttccataagagtaaataaaaatgaatatgcagtggctgacattgttttaaagtcactggtactatggacaactccatagtgaatggagatacttgcagagcttgtcatgcacactaagagtttaaaatgtgagctcattattaatcatagtttcaaaattatcaaataaaaccagtgaagatctgaagatgcaaacatttcaactatgaagatttacatttcactttctaatttattaaacatctgtgtgcctttttatctttggtttcttttaaaaagtatatttaatgcctttacaatacctttaatttattaggatctcagaatcattgtttactatcccttatttgacaaaaagtcaaatgtgtatgttctacctccaacggaaatgtttacaaggtcaagacttaattcaattcagacaagaccaaagttgcttgacttcaattcctgtgcattagtgtgatgatttctgtcacatagcagcattccgattctatgtaactgaatggagatgataagtgctttcccctctttatttaaaaaagattaaaaggaataaaagaaataatgtatggaaata

SEQ ID NO: 25884 - DNA, 4122 bp, Homo sapiens
atggcagaggaacaacaacagccgccaccacagcagcctgatgcccatcagcagcttccccccagcgcccccaactcgggggtggccctgccagcccttgtgcccgggctgccagggacagaggccagcgcgctgcaacacaagatcaagaactccatctgcaaaactgtacaatctaaagtggactgcattttgcaagaagttgagaagtttacagacctagagaaactctacctctaccttcagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaatattgctacagtggactaagaaaaaaagcttttgttcatatgccaacactgcccaaccttgactttcacaaaactggagatgggttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactaattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctgaaataccctgatgtattaggagaatga

SEQ ID NO: 25885 - DNA, 4137 bp, Homo sapiens
atggcagaggaacaacaacagccgccaccacagcagcctgatgcccatcagcagcttccccccagcgcccccaactcgggggtggccctgccagcccttgtgcccgggctgccagggacagaggccagcgcgctgcaacacaagatcaagaactccatctgcaaaactgtacaatctaaagtggactgcattttgcaagaagttgagaagtttacagacctagagaaactctacctctaccttcagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaatattgctacagtggactaagaaaaaaagcttttgttcatatgccaacactgcccaaccttgactttcacaaaactggagatgggttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactaattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctgtgttcttgtccttcctctctgctggctggaatgcaaatgtga

SEQ ID NO: 25886 - DNA, 7194 bp, Homo sapiens
atggcagaggaacaacaacagccgccaccacagcagcctgatgcccatcagcagcttccccccagcgcccccaactcgggggtggccctgccagcccttgtgcccgggctgccagggacagaggccagcgcgctgcaacacaagatcaagaactccatctgcaaaactgtacaatctaaagtggactgcattttgcaagaagttgagaagtttacagacctagagaaactctacctctaccttcagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaatattgctacagtggactaagaaaaaaagcttttgttcatatgccaacactgcccaaccttgactttcacaaaactggagatgggttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactaattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctggtaggtcagggagcatctgatctcactaatactgcatctgatttctctagcgatatcaggttgtcttctgagctctcaggcagcatcaatgatttgaacactttagacccaaatctactgtttgatccaggtcgtcagcagggacaagatgatgaagctacactggaagaattaaagaatgacccattatttcaacaaatttgcagtgaatccatgaattctatgacttcatcaggttttgaatggatagaaagcaaggaccatcctactgttgaaatgttgggttaaattgtgttttataacatgtagcacactgtatctaaagacatatgtattgtatttgtcttaatggaagtgcctcccgcagcagaaatactattaattgtgacattttaaaagcgtttgctgcagaagtggtttcttcagtaggaaatggttagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaactgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcctactaatataaaaataatggaaatcttttttgataaaaatattaagactggaggatttttaaccccttgtacagtattgcagcaaactctttaaatttggttgaattcgtccagcaaactttctggggttcatatattgcactaaatttgttgaacctgtggtaggcacatctcttaggataaatgcaaccaatacagtccacagattaaactttttaaatgtgtttcattatgaaaagacaaaatgtcatcaaagtgacagataaaattgtcttatgtagcaatgtgcattgatctcaatgagatatttctattattctcttacatgagaatattacagcaggaagaattaagtttagtttgcttcaccatgttaatacatgatcacaaaatgtgcatgagtgttattgacttatcttgtacagtactaggattcctgtaaccactcttttttttcttcgctgtattgaaactggttcagtgttaaccaggcaagcatagttattcacaggttatttactttatgtttactaattctgcttagttattgttgaatatgttctgttccagattatttttattgttttgatgtttaaaacattttgcatactgtttatcataaaacttcatgaagtaaataattttgcatataattgcaataagcactgacttttgaactgaaaagaaggaaagtgtttttttgtgcagtgcttctgaggttcatataatagtcttgtactataatgtgctttactacacgataaatgacaaaaacaagccctgtttcatgtttcatttagtgcaaaaagtcagatttccccagtgttttgttgtctgttgtacctgctgaaactacagtagttgaatattgcggtagcatttcagttctctttttttattaaagtgctcaaaaattgttttttaaatgttttcaaaaacaattaaaaacattttatattaaactg

SEQ ID NO: 25887 - DNA, 7036 bp, Homo sapiens
ttcttttagcaaaactgtacaatctaaagtggactgcattttgcaagaagttgagaagtttacagacctagagaaactctacctctaccttcagctgccttctggtctcagcaatggagagaaaagtgatcagaatgccatgtcatctagtcgggcacaacaaatgcatgccttttcctggattcggaataccctagaggaacatccggagacttcactgcccaaacaggaagtctatgatgagtacaagagctattgtgacaatcttggttaccatccattaagtgctgctgattttggaaagatcatgaaaaacgtctttccaaacatgaaggcacgtcgtttgggcacaagaggcaaatctaaatattgctacagtggactaagaaaaaaagcttttgttcatatgccaacactgcccaaccttgactttcacaaaactggagatgggttggaaggagctgaaccttctgggcagcttcaaaatattgatgaagaagttatctcttctgcttgccgtcttgtgtgtgagtgggcccagaaagtgttaagccaaccatttgacaccgtcttggaattagcccgcttccttgtaaaaagtcactatataggcaccaagtcaatggcagctctaactgtaatggcagcagcaccagcaggaatgaaaggaattacccagccttctgcttttatacctacagctgaaagtaattcctttcagcctcaggtgaagactttgccatctccaattgatgctaaacagcagttgcaacggaaaatccagaagaagcagcaagaacagaaactacaatcccctttgccaggagaatctgcagcaaaaaagtcagaaagtgctacaagcaatggagtgactaatcttcctaatggaaatccttcaatcctttctcctcaacctattggtatcgttgtggcagctgtccctagtcccattccggtccagcggactaggcaattggtaacttcaccgagtccaatgagttcttctgacggcaaagttcttcccctcaatgtacaggtggtcactcagcacatgcagtctgtgaaacaggcaccaaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaggagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactaattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctggtaggtcagggagcatctgatctcactaatactgcatctgatttctctagcgatatcaggttgtcttctgagctctcaggcagcatcaatgatttgaacactttagacccaaatctactgtttgatccaggtcgtcagcagggacaagatgatgaagctacactggaagaattaaagaatgacccattatttcaacaaatttgcagtgaatccatgaattctatgacttcatcaggttttgaatggatagaaagcaaggaccatcctactgttgaaatgttgggttaaattgtgttttataacatgtagcacactgtatctaaagacatatgtattgtatttgtcttaatggaagtgcctcccgcagcagaaatactattaattgtgacattttaaaagcgtttgctgcagaagtggtttcttcagtaggaaatggttagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaactgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcctactaatataaaaataatggaaatcttttttgataaaaatattaagactggaggatttttaaccccttgtacagtattgcagcaaactctttaaatttggttgaattcgtccagcaaactttctggggttcatatattgcactaaatttgttgaacctgtggtaggcacatctcttaggataaatgcaaccaatacagtccacagattaaactttttaaatgtgtttcattatgaaaagacaaaatgtcatcaaagtgacagataaaattgtcttatgtagcaatgtgcattgatctcaatgagatatttctattattctcttacatgagaatattacagcaggaagaattaagtttagtttgcttcaccatgttaatacatgatcacaaaatgtgcatgagtgttattgacttatcttgtacagtactaggattcctgtaaccactcttttttttcttcgctgtattgaaactggttcagtgttaaccaggcaagcatagttattcacaggttatttactttatgtttactaattctgcttagttattgttgaatatgttctgttccagattatttttattgttttgatgtttaaaacattttgcatactgtttatcataaaacttcatgaagtaaataattttgcatataattgcaataagcactgacttttgaactgaaaagaaggaaagtgtttttttgtgcagtgcttctgaggttcatataatagtcttgtactataatgtgctttactacacgataaatgacaaaaacaagccctgtttcatgtttcatttagtgcaaaaagtcagatttccccagtgttttgttgtctgttgtacctgctgaaactacagtagttgaatattgcggtagcatttcagttctctttttttattaaagtgctcaaaaattgttttttaaatgttttcaaaaacaattaaaaacattttatatt

SEQ ID NO: 25888 - DNA, 1389 bp, Homo sapiens
tccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcag

SEQ ID NO: 25889 - DNA, 1369 bp, Homo sapiens
ccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacagggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatga

SEQ ID NO: 25890 - DNA, 796 bp, Homo sapiens
cagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaaggtacgctgcccctttaagttccagacgccccgcgtacttcccctacttcttcttcttgagatagccccgcccatctacccgaagccggagccaattggctccctctggaaaaatctgtgggcagggtaaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcag

SEQ ID NO: 25891 - DNA, 1281 bp, Homo sapiens
tccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactgtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtggg

SEQ ID NO: 25892 - DNA, 2304 bp, Homo sapiens
gcgcagtcggggcgccttcccggtataggcgccttttaccccagcgtgtcctgagtctttggttcgcgaagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcaccctgctagtgatgcaaccctgtgctgggcaggacgaggctgcggcccccgggggcagcgttggggcgggcaagcccgttaggtacctgtgcgaaggggccggggatggcgaagaggaggctggggaggacgaggcggacctgttagacacttcggaccctccggggggaggcgagagcgcggctagtttggaggatctagaggacgaggagactcactcggggggcgagggcagcagcgggggcgcccggaggcggggcagcggtgggggcagcatgagcaagacctgcacctacgaaggctgcagcgagaccacgagccaggtggccaagcagcgcaaaccgtggatgtgcaagaaacaccgcaacaagatgtacaaggacaagtataaaaagaagaagagcgaccaggccctgaactgcggtgggactgcctcgactggcagcgcgggaaacgtcaaactcgaggaaagtgcagataacatactctccattgttaaacaaagaacaggatcttttggggatcgtcctgcaagacctactcttttagaacaagtgttaaatcaaaaaagactgtcgttactaagaagtccagaagtagtgcaatttttacagaaacagcaacagctattaaatcagcaagttttggagcaaagacaacagcagtttccaggaacatcaatgtgagggaacttaccaagaacatctacatggttttttatcttattgtaatagatgagcatatttttttaccagacataaatggggtaataatctatgcctgtagaacataaacattttcctgtaaatgtatgtgtgcatttggggataagtaagtattgcactttgtgcatctaatctttcagattactgtgagtttgaagaagtcagcttatctttccaaataacatttaattataatgttttttaaaaaatatattcctcttcagtcattgttactgaaggtaatgaagcagttactttctgtggaagtcataaagttaatagatattaatcttgactcatctagctcagtggttctcatcaagggtcaatttgattgtcatagtgaccttgaaaaccactggcttttagtgagtggccaggaatgctaaatgttctgcagtgtcaggggtagtcccacatactaaagattgtctcacccgcagtgccaataacactcctaagaaatgttgatggctattttgtggtgctaacatgtagttggggcacctataattgggttctcttaataacctttctttgcagttaagactgaagctgtcaaagaggtaagcacattttatatagacgtaaggaaagtgattattgtttaatatctgtgaatttaggatgtgcatctcttttcagaggtgtgttagtaaaacctgacggattaactaagcacactgggatgtgtctcctacagttggcttctctctttgatgttacctgttagtgctgatctcttaaagcagacatttcttgtttgttgaatttgtgaacagtatagatctcagcccaccaatgccaagacaaaattatttttcttatacttattttttattaaacaaaatgaaaaagatccttttcaaaaaggtgatcctgaaaataaaactaacactccagtattttgtcattgtttttcgcaattgagctatctgaaaactgttattcctaagtaatgttcaaaaatgataagtaatctggatacctttttcttatactttctcctaggaaaactttaaaactttaaaaaggcaaacctaccaataggaataacaaattaaatgtcaagagagtatatccaatattaggatataaatgtatgtgtctcaagtttaactctacaaaaatttgttacttgttttttaaactctatatataaagttcgacttaatcatggctgttctaagaagtacttatggagagcaagaacgtttttgttcatttcttaatgtgtgtgtttttacttgcatatctgttcaaaacacttttaacaaaattaattcattaaagtccagttgttgacctttga

SEQ ID NO: 25893 - DNA, 1854 bp, Homo sapiens
atgtcatcattaccaacttcagatgggtttaaccatcccgcccgttcttcaggacagagtcctgatgttggtaatcctatgagtcttgctcgctctgtctctgcttcagtctgccctatcaagcccagtgactcagatcgcattgaacctaaagctgtgaaggctttgaaggcttcagctgaattccagctaaactctgaaaagaaagaacatctttctttacaagatctttctgatcatgcttcctcagcagaccatgctccaacagaccagagtccagctatgcctatgcagaattcatccgaagaaataactgttgcaggtaatctggagaaatctgctgaaagaagcacccagggcctcaaatttcatctccatacaagacaggaagctagtttatctgtcacatctactaggatgcatgaaccacagatgtttctaggtgaaaaggattggcatccagaaaatcagaacctgagtcaagtgagtgaccctcagcagcacgaagaaccagggaatgaacagtatgaggttgcacaacaaaaagcttcacatgaccaagaatatctttgtaacataggggaccttgagcttcctgaagaaaggcaacagaatcaacacaaaattgttgatttggaagctacgatgaaaggaaatgggctcccacagaatgtggatcctccaagtgcgaagaaaagtattccatcttcagaatgcagtggctgctcaaattcagaaacatttatggaaatcgatacagctcaacagtccctagttactttgcttaattcaacaggcaggcagaatgccaatgtcaagaacattggtgcattggatctcactttagataatcccttgatggaagtagaaacatcaaaatgtaacccttcatctgaaattttgaatgattccatttccactcaggatttacagcccccagaaactaatgttgaaatacctggaacaaataaagaatatggccattactcctctccaagtctctgtggcagttgtcagccttctgtggagtcagcagaagaatcttgcccgtctataacggcagccttgaaagaacttcatgaacttttggttgttagcagtaaaccagcttcagaaaatacatctgaagaagtaatctgtcaatcagaaaccatagctgagggccaaaccagtattaaagacctttctgaaagatggacccaaaatgagcatcttacccagaatgaacagtgtccacaagtctcctttcatcaggccatatctgtatcagtggagacagaaaaattaacaggtacttcatctgacactggaagagaagctgtagaaaatgtaaacttcaggagtctaggtgatggcctgtcaaccgataaggaaggtgtccccaaatctagggaatccataaataagaaccgttctgtcactgtaacctcagctaaaacatccaatcagttacactgcaccttaggtgtagaaatttcacccaaacttttagcaggtgaggaggatgcactcaatcagacttctgagcaaactaagtctttgtcatccaatttcatattggttaaagacttaggtcagggcatacagaattcagtaacagacaggcctgaaaccagagaaaatgtctgtcctgatgcttcgaggccattacttgaatatgaaccacctaccagccatccatcatcaagtcctgccattcttccaccattgatttttcctgccacagatattgaccgcattctccgtgctggctttactttgcaggaagctcttggagctttgcatcgagttggtgggaatgcagaccttgcacttcttgttttgctcgcaaaaaacatcgtagttcctacatga

SEQ ID NO: 25894 - DNA, 983 bp, Homo sapiens
ggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccagtcctacttcgtgtctgactacgaccccactattgaggactcctacacgaagatctgcagtgtggatggcatcccagcccggctggacatcctggacaccgcgggccaggaagagttcggggccatgagagagcagtacatgcgtgctggccacggcttcctgctggtgttcgccattaacgaccggcagagtttcaacgaggtgggcaagctcttcacgcagattctgcgggtcaaggaccgcgacgacttccccgttgtgttggtcgggaacaaggcagatctggagtcacagcgccaggtcccccgatcagaagcctctgccttcggcgcctcccaccacgtggcctactttgaggcctcggccaaactgcgtctcaacgtggacgaggcttttgagcagctggtgcgggctgtccggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacg

SEQ ID NO: 25895 - DNA, 1516 bp, Homo sapiens
cagacggccatttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaa

SEQ ID NO: 25896 - DNA, 1884 bp, Homo sapiens
gcagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgt

SEQ ID NO: 25897 - DNA, 970 bp, Homo sapiens
attgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaatcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatat

SEQ ID NO: 25898 - DNA, 1278 bp, Homo sapiens
atctcagatgcatgcagctcctgctgggcggtttcattctctgccagccattcattcacattaaaagcaatggcccattaaggaaataagtggatgatgctcctccatcacccatgtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcattta

SEQ ID NO: 25899 - DNA, 497 bp, Homo sapiens
aatatttttgaactgtggttgactgtgggtaactgaaaccaaggaaagtgaaactggggataagcaaggtactgtagttttctttgatcagcacctgaaagatactgtgccacttcttctgatccccatggtttctgatgagaaatctgctgtttttctcctgtagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcac

SEQ ID NO: 25900 - DNA, 982 bp, Homo sapiens
attgctctggccgaggccagagacctccgggagaggctgggccaccgagccgggctttactgctccgagggtccgggcgtggggctggagctggagccccgcgcgctgcttttccagccgcctgcggccgcgccttcaccgtcggggcgatagcggtggcaacttggccgcggctccgcgtggtctccgggcttccccgcgccgcctgagccggagctgcccgcttcaagtactgtgtatttctttgttcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaa

SEQ ID NO: 25901 - DNA, 993 bp, Homo sapiens
gtggtattcaggtgatgaatgtggattccgttttgagttggagaaatttctttttgtcagtttggatttaattttaagaaataatgagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatataggg

SEQ ID NO: 25902 - DNA, 2034 bp, Homo sapiens
atctcagatgcatgcagctcctgctgggcggtttcattctctgccagccattcattcacattaaaagcaatggcccattaaggaaataagtggatgatgctcctccatcacccatgtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatc

SEQ ID NO: 25903 - DNA, 2358 bp, Homo sapiens
cagacggccatttgtggcggcgctggaggctgcgttcggcaggcgctgcggagacgcgtagaggagcgcgccccccggccgctgccgcccctggcccgtgccgtcaccccgcttctccgcgcctcgggcggtacccagccagtccccagcgccgcgctaccgcgctgaccggccctccagacgcctcccggtacccgggaccccagcccggccgctcgcccgcagcccgccggccgcacacgtccccggagccgggcctagggcgggcggcagcggcggctcggcgcagtcaggctgggctctgtagcgtccccatggccgcggccggctggcgggacggctccggccaggagaagtaccggctcgtggtggtcggcgggggcggcgtgggcaagtcggcgctcaccatccagttcatccagttttttcttttcttgcagtcctattttgtaacggattatgatccaaccattgaagattcttacacaaagcagtgtgtgatagatgacagagcagcccggctagatattttggatacagcaggacaagaagagtttggagccatgagagaacagtatatgaggactggcgaaggcttcctgttggtcttttcagtcacagatagaggcagttttgaagaaatctataagtttcaaagacagattctcagagtaaaggatcgtgatgagttcccaatgattttaattggtaataaagcagatctggatcatcaaagacaggtaacacaggaagaaggacaacagttagcacggcagcttaaggtaacatacatggaggcatcagcaaagattaggatgaatgtagatcaagctttccatgaacttgtccgggttatcaggaaatttcaagagcaggaatgtcctccttcaccagaaccaacacggaaagaaaaagacaagaaaggctgccattgtgtcattttctagaatcccttcagttttagctaccaacggccaggaaaagccctcatcttctctttctctcctcagtttacatcttgttggtacctttctagccttagacaaatgatcaccatgttagccttagacgaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaaaactgcttataaaaccctgtgttactactcctactcttggagatgataatattctatgtggtcaaatatttggactcatttaggacttagatatttcagtgtacttgattttttaatttaactctttttcacagccacgctaagggtaaaaaggaataatttccttctgtcttccttttcaagtatttctgggtaagggattcaaaaaactaaaactgtttttgtttgtaatataaaatatggaattgatctttccagggtcagagatgattaatgtttttgctatatacttttatacattattttcttatcaaactagttaacaagtatttttatatgtttgtaagcagatatgctttcatagcataccttgtgtatatgtaaagataagtatttaattctcactgttcacttttaactgacaaagaaaaacaagtggaaactacagaaactgtggtagaacttttacttgctggtctggtcttggttgtacccatctttggccagtcacataactactcaagaaaccttcccaatagagtacaacaggatgagactctgaaatcactttcagtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctagaattaaaattgatctgttatc

SEQ ID NO: 25904 - DNA, 1068 bp, Homo sapiens
ggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgccacttt

SEQ ID NO: 25905 - DNA, 967 bp, Homo sapiens
ggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgccacttt

SEQ ID NO: 25906 - DNA, 580 bp, Homo sapiens
gccaagaggcagcagagacactggcccactctcacgttcaaagcatctccgtccagcatggccaggtacatgctgctgctgctcctggcggtatgggtgctgaccggggagctgtggccgggagctgaggcccgggcagcgccttacggggtcaggctttgcggccgagaattcatccgagcagtcatcttcacctgcgggggctcccggtggagacgatcagacatcctggcccacgaggctatgggagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctagtttgagggctgggcagccgtgggcaccaggaccaatgccccagtcctgccatccactcaactagtgtctggctgggcacctgtctttcgagcct

SEQ ID NO: 25907 - DNA, 3535 bp, Homo sapiens
agagcggcgagcccctccgcggctcggggtgagtcgggcgcggggcgcagaccgcgctctgacgtcgggggcggagcggccgtgacgcgcgggggcgggtctgcgcaccttcccggcccagccggcgattcattcaaaaggcgcgcaggctgcgcggctgtccgggcgctcgccgagccgggccgcggcgccgagtcgaacggggagccgagctggagctgccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagtataaaaagtgtgaatgagctgtttttgcttttgctttgaaatctggagtgtatcttacacatcttgattggaactcaaatatttcaagggctccatagccacgtggccagcagctaccacactggtcagcgcagcacctgaggaaatgcactgtgtggagcccgggaggtaattgggggtgaggaagatgtgcgggccagggaatgtgttccacagagagggacagcatgtgcaaaggctgagcaccaacacatagtggtcacctgggccttatgcccagggagcctccaaagcattcagctcctgcttggccagtgtggagaggaaaggagccacaggagcgggtgctacacccggcaagacagagcgtctccatctaaaattcctagggcaagcttccaacccggcccaagggccgcatgtggcccaggatatggctttgaatggggcctaacacaaattcataaactttcttaaaacatt

SEQ ID NO: 25908 - DNA, 2669 bp, Homo sapiens
cgcgtcctgtcccggcgccttccgcgcaccggccaccgccagtctccgagccccgtgacctgcaggtcctccggccgcgactccgggccggccctgcgtggtggctgtcggggggcgcgcggggaagcagcggaacttgcggtgtgaggggccggcggggcccggagcggtccccggcccgggaaacttggaccgagaccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgc

SEQ ID NO: 25909 - DNA, 2395 bp, Homo sapiens
atgcacccgggctgttgggtgcaggaagcactggtgttgaatcatgaaggtgatatgggcttctctgagcctggatcccacatttgcagggctctgggaggcttgtcacctaaatgcacatgctcagggcccttaagaaggccagggttgccctctgctggcagatcatggtttagctcaggagtgcggcttcccccttccccaggatcagggcccttctcttccccaggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgctgtcacgaggagctccttttctctgtgcccttcccagcttatccgcctgttccacttgtacctgtccagccctgccctgtgttgggcaccgtgacaggctgccctcccctcacagttcctgcacctcagcagccagggaagcagggcccagaggagacccatcaactcatctggttctcaccaaagcccctagctagaggcagggctgtcccacagaaatagtgtgagccacatatgtgactttaaattttctgacagtcacatttcaaaaagtaaaaagaagcaggtgaacttaatttttttttaacccagtctatccaaaatattttcatttcaatataaaatcagt

SEQ ID NO: 25910 - DNA, 586 bp, Homo sapiens
aaaggcgcgcaggctgcgcggctgtccgggcgctcgccgagccgggccgcggcgccgagtcgaacggggagccgagctggagctgccgcggcgcagccagattcccaccagggcgaacccagcaccgcctgtataccagactctgtgccaggcactgaacgtaaataaaagccttaccacagccctctgcaggcaggccacagagccagtgcaagacagagcagagcaggactgcaccccatactttgtatccccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggg

SEQ ID NO: 25911 - DNA, 11550 bp, Homo sapiens
ttgttttcattccccctgtcacacgaggcagtggcaagcccgaaggggaggagagaagggggcggaaagagggcggaaagtgaaaggcgccgagggccgctctgtctcccgtctgactcggttctcgactgctccgggccgccgatgtattgtgggatcgcggagccgtccctgagacgctgggatccgcagaggagcccacttgagagcgcctcctgtcgtctgtaaggttgccttgccatccctcggcaccacaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaatagcatgtggttccaagtaagttgtgatttttattttgagacagtgttccactggaagggagggaagggcttacattcacagacagtaaagcagggctgtgtaaggagctacatttacttaacagtctcctttccagctaggtttgttttatttatttgcaagtcagctaagaattaaccttttaaaccatctaaaacaggcaagcaatataaagatttctactagtgcaaggtaagtggtttgaatatacaagtgccctttcctgccacccagtctcactaccgttttagtcctgcagctgggtaaagccactattgtgtggaaactctcccatgtgccctgtctctacctctggacacaccagctccttcttccacctattctattcctcagttaagccaagtgatcagaagtagtattaaatgggtagataattttaacaggatgcctaatgtgaaataaggagttatttttactcttctactatagaaagcctaaggtaattcttaccatctcaaagactgagtattccatttaggtttggagaccacttgtgctgtgctgcctgatatttaccaaacttgaataagtgttcgtcaacttgatagtgaatgtaccccttctcaccttatattttgattaaatcaattaactataggtcatctaccaagaatgtaatccaagcggttgataaaacattattaggcagatagattattgattattaaattttgagcagtgcaaaaacggttttgctgcttggagttcagattcagtccctcaaagagtttatgatcactgaaatacactctgaaggtattctgaagaagttaaaaaattttagaaaacgaaatgttctgtatacaaagacaatacagtcactacgaactgcagaaagtataggaaagcagtaattgatgtagagtttagacagtcttggatcttttttagagcactaaccatggatttagactcaaaatagctgctacataatagagccctttaataatttaaaccccccttgttgaaatacaagttggactcccagtgtcaaactctagactgtagctaatgtattaaagggagatgtagattaatattcagtatatttagtttgcaatttctgaaaaggtttgaaaactagtcagcttttcacacagcagaagctttgaactgaaatatgtgtgaaaaggacgcagactgaaaacgttttggttttgtacatcagtgctgatgaaattagtgtaaaacattttccatcattggcacattactgcaaaatgatggcagagatattttcaagaatgtacatcaagttatatttccttgacatccttttttcaattggtcaaggttacagattcagaggataaagggtagtttcatttagaataaattcatgtctactggcaatctatatataaaagtgacctgcccaagaaccaaaaactttaaatgctaatgaagcttttgaaaaataatttttaaacaaattaattttaaaagggtgttacacgtacccagtttttactttttagttgatgaaacccatcctataatatacatttgagcaaagtacacatattaagaaaaacatggacatttacttgtttaatagtcaaaatgatgaggaaatgttagctgtttttaagtgggactggtggggtgtcctttgtcacaaggaatgcttttttagcttgtttgtgggcataagagatgttaaccctttgctgattctaccacacaactgtaaagaacctaatgaatctacaagtttaatattcagaaaaagctaggaactccgctctttaccagtacagtggaacaggcccgttattcaaggtgatgcctcacagctatagaacaactattcaaagacccagagttaaatggtacatgtgtatatgtgtgtgtgtgtgtgcacacgcacacacttcagataagtatcagaaaaaataaaaatgaatccatcattaacttgaaagaaataagatggctgcattgcaacagatacaaatattatgaacatcatttaattacagaaaatctagacaacagtttctcctgatgtttgacattctcaaaatatattcctcattctcgaagaagcagagaatgccaaggctgcatatctgctgtaatctacctagccctcttctgcttaatatgatccattattgaatcttctcagattaaaatccattcctatatcatctacctttcccaaagtgtgtgcctgtaaacctaccttggaagtggcaagttaactgatttttttgtgtcatttttataccaatccttaaggtcaaagccttttgctatcaatgtatttaaactgagttgctatatgttcactaatttgttttcaaaatgttttgctccaacttaaattatcttttaacatcttttgagtgccaagaattgctaagtaactgtaatatgttgaagagagtaattgccaagcaagcagtcataagccaaaatgtaatgagcttagtatataaccactttagagtatacactcaccactttttgtattcattcatgcaaaccctcctggaagtcgattagaagaggatccaatttgtggaccttttttcctccttttggacacctgagcacaattttttttttcctttcatatttataccactttggaaaattcagtaaacccaattctggcacatcataatggtttcagttagtgaagatgtttattttaataactttaaaatatgactatcctatacataagttatataagagggcataacaatagatgagtagaaatttataaaatttcttggatattttgaatgagaaaaaaacatttttaaaggaattttgttttttccttttttggccaaaccggtacaagttagaaagtgtgctaaggactgaatacttgcctcgtgctttttgccactggatgatgtaagttaagaatggaattgttaatcctaagtatatattttcttgactttcatcagtttctaaagaaatctaatttaagtgttttgcggttttgtttgatctgtatttattgagttctggtcatagaccagcagcttgcacgtcatgctcatgaacagccagaacatagttattggggaacttcatggctcaaaaccttctgaatcatttaacttattttgtatgttgcaaaaaaaaaaaaaaagtttattttgcttgagagtcacctttttttaaaaaaaataactgtacagcttttaagggatgggaggtgggaaaataccctaaaataggatgtagattttttacaattgtgtttatgctagatcatctacaggtgcattatgtaattaaacctaaaattgtttaaaaatttgtgccatgtctttttcattctcctgccctttagcagaattggtgcatgtcaactgctatgtggacaagccttgaaattagagtaacaagccctgtctccaaagctttaaggtcactgcatgaaaattgcacacacacacacacacacacacacatctagcttatattagtaaatggattttcaggatcagaacagctacagtagcccagatttggctgttaacagcatattcttacagcacatgatttttgtgatgcctaactagggtattctcaatgttagtctggtgttctattctctttcaaagtagcttcttgagatggtatctgttgtagcttgcccaaacctgccatgaggttgtgtgtacactttgaaagggtatgtcctatgctaagatggtggtagagcagggcttgattttaatctattcatataaaagaaggaaaaaactagaattggtctatttggttattcagtggacttaattccacaggaatagttgtctgctgaagcgtggcagcaagagaagtcaaattcaagtttcagttccttccttattcactaagtattttgaaatcttgtagaacttctgattctagcacagtcttttacatggcacattttaccatggtatattcacagcttcgtttaaatgtcagtactttttcccatctgataattttgccattctaatttctcacctttgtagtacaagtgtattcttgaaaataattaaattcatctaagtgtgtcataatttcaatcaaagctatattcatgtgttgccagcgtcagttttttgctatcctcattcagaagggaagcctgcagatcatgagtttccatatgaagaatacaaattccacataaaaatttataaatggtatctttagaattttgatttaaagtaatagctggaattcagggactgatcagaatgcctcttgaattttccaacatgcttatatgaaatgctttattttcctatgcgttaaaaaaaatattcctggaataggttctcagaatgttttatttggtttctaggagatgagatttaaagcagaagctccaagattggcataaaactaactcttgaggtaatcaggaccatgctgttagtcaaatagaagctggagtgctctctgtcacataatgtactgcatgtgtgtgggggtgggggggcagggaagatcagaaaactggaaatgtaattctgataacacgcaaagtaaattgtgcattaaaagtatgggaattcttggtagcttaaagcttcaggggttaacttcagtgtatgaacacctagtgtgttagaattgcagtgcatagttgtttaaatacaatattccttgtaagtgacaaccaaaatatgttgtggctggtgccagtatttttgttaatgaaatgttcagtgtctcactacagtctgatcagaactcttggtgttataagccaggcctaaagccattttatagctattggcctaattgtgtaactttttctttcaaaatgttttattataatacttctgtcatttctttcacttaatatgtcaattgtcataataaaaatttaaatttgaattatttagcatga

SEQ ID NO: 25912 - DNA, 5040 bp, Homo sapiens
gatccgcagaggagcccacttgagagcgcctcctgtcgtctgtaaggttgccttgccatccctcggcaccacaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagc

SEQ ID NO: 25913 - DNA, 5318 bp, Homo sapiens
ctggtttatcaacttgacgagaatcatttcaaaattttaggaaaaaaatttatgtctcagtaaaactttgtttagaattaggtttttcagtagcaaggataaggtgaagggattaaaaatgtacgtaaaattagtagtcaatgaattctggaatgcagtctgtataatcctattcagagattatgctatttactgaatatagctttggttgtgtttaaatctgcactagtattaggtgctccttaaaagttgaaaatatatagccaataaggtataaagaagaattgacagataaatctaaacagtttctttgtatagtactaacttctgaaatgttcagtggtggcatttgataaagtaagttgtaatatgatcacattgaggaatgttatataattattaaactcaatttttataaaaggcatcattttataaaagtatcataagaaagtgccaatgtttcaatgaataaattgaggcaacatgataccaacttagtgaaaaatatacaagaccagaaggaagtaacctaaaatattactagtgattgcctctgggtaataggatatgggctttttgtctttctatatttttcattttcccactgccgtgttcctggtacctcagtgaaatgaagtgctcagttcttttaacagttgtcagtttttaaaacaaatatagtcttctggaaatgttttaggtagcattttcaattttatgtttttaagccatctcttgaatttgaataaattatttgaactgcataaatatttgcaatccattgagaacaccaaaacaaaaagtaaaaagcagaaacctaaatttttctaaattttttttaatatctagaagttgtatctcaaagtttttgtaattttcttcattgtcagattttattttttactgtcaaatatccaatgacagaggccacctcttttaaaatagaaactttaaatggaaatatacattatactaagtcttatattttatagccttgaaagtttctattcatgtaattaagctttttctgatttttagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagc

SEQ ID NO: 25914 - DNA, 2409 bp, Homo sapiens
gagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaa

SEQ ID NO: 25915 - DNA, 2107 bp, Homo sapiens
gcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaa

SEQ ID NO: 25916 - DNA, 830 bp, Homo sapiens
gaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaa

SEQ ID NO: 25917 - DNA, 1447 bp, Homo sapiens
gcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggttacaaatgctgctgccaactgtcctggccaaatgactctgcatcacaaacctttccttgcatgtggaggggatggatttactcagtccaactttgatggctgcatcacttctgccctatgtgttctggaagctttaaagaattatatttagtgcctatatccttattctctacatgtgtattgggtttttattttcacaattttctgttattgattattttgttttctattttgctaagaaaaattactggaaaattgttcttcacttattatcatttttcatgtggagtataaaatcaattttgtaattttgatagttacaacccatgctagaatggaaattcctcacaccttgcaccttccctacttttctgaattgctatgactactccttgttggaggaaaagtggtacttaaaaaataacaaacgactctctcaaaaaaattacattaaatcacaataacagtttgtgtgccaaaaacttgattatccttatgaaaatttcaattctgaataaagaataatcacattatcaaagccccatc

SEQ ID NO: 25918 - DNA, 3385 bp, Homo sapiens
ttggacttacgtatttctttttattcaagaactctatccaatatatacacattttccttttggcttttgtcatttgtgtctttaagactttgaataatgtttttaaataatattaactttaatctttcatacacctttcagaaatttactatttgtattttgttttgtgtattttgtaacacacaagttgtaaatgattatgtattttctgttcaattccatctttcatttttatgcttaaaaatgtcttcttagtcatatatgcccgtctacattttcttctagttcttttattagatatatctagtattaattcgtcacccatttgatacatggtaatttttttcatgatgtggacatgaagtaaatattctgatttttaaatgtttccattataattggctaccattgtcaattttcttattggttctgatacttattcggtttcttagttttccaggtaataatttatctgcaagtcagcgtaacttaattatttgttttttaatagttcagtattaccattgcctttgttgtttcattgagaacttccagtacaatgtcaggagggggaaaaaaacaacggcaatggcaccaatccttctcttgttgttcatctttatattccttagaacatacggaatgcgttctgacatagaacttattgaagagtaatttggaattttctgatgaatcaactgtctttaatctttacaagtttgaaaggtatacgttattgtttccatttcccagatggagaaattgaggttcaggaaggttacacaaagtcccaggtctaagaaaaatgtctcccagattccaaaagatgtttctattatgctaatagtggccgttcaagcattagaggaaaggttgcccgtggtatcgctggtaaattcttcttcccactttcaaatctagaatagtaaaacagcaaaaatcccaacaggcatgagagttatcgcagtagataggttaagctgcttctctgctgtggtcaacgtcagctctgttgcgaggcgggttctcccaacaatagcccacaccatttccaggcttttctgggcgaggggcagggcgcccggcccccaaagcgagaagacagacagccccggttctccgcagccccaggtttgctcctcaaggacggaggggcctctcagctccggccgcctcctttccgccccctgcaggccggccggaggaaagctcagggcccaggtcggcccagggagcacggaaccaaagagcgctagcgccggttcggccgcctttccagaaagcccgggccgaacggccccgccgcagagactcagcgcggatcgctgctccctctcgccatggcgcaggtgctgatcgtgggcgccgggatgacaggaagcttgtgcgctgcgctgctgaggaggcagacgtccggtcccttgtaccttgctgtgtgggacaaggctgaggactcagggggaagaatgactacagcctgcagtcctcataatcctcagtgcacagctgacttgggtgctcagtacatcacctgcactcctcattatgccaaaaaacaccaacgtttttatgatgaactgttagcctatggcgttttgaggcctctaagctcgcctattgaaggaatggtgatgaaagaaggagactgtaactttgtggcacctcaaggaatttcttcaattattaagcattacttgaaagaatcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctgacttcctggaaattggagcacacagtcaggttttatttgatttttttttttaaggataccacttcacagcctttaggatagctattatttagaagcaaaacagaagataaatgttggcaaggatgtggagatattggattcccttgtgcagtgccggtgggaatgtaaaatgatgtagctactatggaaaatgatacggcaatttctttagaaatgaaatatagaattgctgtatgatctgcagttccacatctggatatctatccaaaagaagtgaaagtagggacttgaacgaacatttgtacaccaatgttcacagcggctttattcacaacagccaaaaggtggaagcaacccagtgtccatggatagatgaatagataaataaaatgtggtataaacatacaatgggctattgtttagccttaaaagggaaggaaattctgacatgctgcaatatggatgaagcttaaagtcattatgcaaagtggaataagcctatcacaaaaaataatattacataattctacttatatgaggaatctagagcagtcagtttcacagagacagaaaatagaatggtggttgccaagggctgggagaagagggcaatggagagtgagtgtttagtgggtcagagttttagtttgggaaggtaaaaagttctggagatggatgatggttatgggtgctcaacagtgtgaatgtacttaatgccacagaactgcacatttaaatgtggttaaaatcatcacttttatgttatgtatatttaccacaataaataaagaagttgatatttcttatacttacaaagaggagaagggcatttgcaaatcaacaagaagtgtgaggcccctctctctagcagaaaaatagactaaatctatttctttatcttttaacatcctgtttaagggaaatgccaaaacaaatgggaaaaaatacacacacacaaatatatatgaacatgttttgcctcatgagtaatcaaaatgtgtacatatgtatgtttatgtatgtgtgtttatatttaaaatcgtgttctgccttatgagtaaacaaaaagtatacaaattaaaaactataatgaaacgt

SEQ ID NO: 25919 - DNA, 699 bp, Homo sapiens
atggcgcaggtgctgatcgtgggcgccgggatgacaggaagcttgtgcgctgcgctgctgaggaggcagacgtccggtcccttgtaccttgctgtgtgggacaaggctgaggactcaggtgcagaagtctacttcagacatcgtgtgacacagatcaacctaagagatgacaaatgggaagtatccaaacaaacaggctcccctgagcagtttgatcttattgttctcacaatgccagttcctgagattctgcagcttcaaggtgacatcaccaccttaattagtgaatgccaaaggcagcaactggaggctgtgagctactcctctcgatatgctctgggcctcttttatgaagctggtacgaagattgatgtcccttgggctgggcagtacatcaccagtaatccctgcatacgcttcgtctccattgataataagaagcgcaatatagagtcatcagaaattgggccttccctcgtgattcacaccactgtcccatttggagttacatacttggaacacagcattgaggatgtgcaagagttagtcttccagcagctggaaaacattttgccgggtttgcctcagccaattgctaccaaatgccaaaaatggagacattcacaggtaccaagtgctggtgtgattctaggatgtgcgaagagcccctggatgatggcgattggatttcccatctga

SEQ ID NO: 25920 - DNA, 1447 bp, Homo sapiens
ctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcaca

SEQ ID NO: 25921 - DNA, 1456 bp, Homo sapiens
agaacctcagtggatctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacaggaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcacagcc

SEQ ID NO: 25922 - DNA, 1465 bp, Homo sapiens
agaacctcagtggatctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattggcatcggcaccccaccccagaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagatggggagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcacagcc

SEQ ID NO: 25923 - DNA, 1388 bp, Homo sapiens
agccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcg

SEQ ID NO: 25924 - DNA, 1388 bp, Homo sapiens
gtggagggtcgcggcaggaacaagtgcgggggtcgggctcaaagccccgccccaggcccagcggaaccctgaagaggagggggagggtgagccgggcgcggctgtgtcagctgagtgacagtcacgggaccgcgaccaactctgtctggcttcctagaggagcaggagggatgagcaagggtctcccagcgcgacaggacatggagaaagagcgagagactctgcaggcctggaaggagcgcgtggggcaggagctggaccgcgtggtggctttctggatggagcactcccacgaccaggagcacgggggcttcttcacgtgccttggccgcgaggggcgggtgtatgatgacctcaagtatgtgtggctgcaggggaggcaggtatggatgtattgtcgcctgtaccgcactttcgagcgcttccgccatgctcagcttctggacgcagcaaaagcaggtggtgagttcttgctgcggtatgcccgggtggcacctcctggcaagaagtgtgcctttgtgctgactcgggacggccgcccggtcaaggtgcagcgaaccatcttcagtgagtgtttctacaccatggccatgaacgagctgtggagagccacaggggaagtgcggtaccagacggaagcggtggagatgatggatcagatcgtccactgggtgcaggaggacgcgtcgggactgggccggccccagctccagggggccccggctgcggagcccatggcggtgcccatgatgctactgaacctggtggagcagctcggggaggcagatgaggagctggcgggcaaatacgcagagctgggggactggtgcgcccggaggattctgcagcacgtgcaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataaaggctgagtccgctcc

SEQ ID NO: 25925 - DNA, 3569 bp, Homo sapiens
atcctctctgactcctgaatcttctgctccttcctcctcaagcaggttcacccgtacttgtcaaaatggctcaactcctgaatagcatactcagtgtgattgacgtattccacaaatatgccaaagggaatggggactgtgccttactatgcaaggaagagttgaaacaactgctcttggctgagtttggagacatcctccagagaccaaatgacccagagactgtggaaaccatcttgaacctcttagatcaagaccgagatggacatattgattttcatgagtacctcttgttggtgttccagttggtccaagcctgctatcataagctagacaataagtcacatggaggcaggacctcacagcaagaaagggggcaggaaggagcacaagactgtaagttcccaggaaacacaggcagacaacacagacagaggcacgaggaagaaaggcagaactcccaccacagtcagcctgagagacaagacggagattcccaccatggtcagcctgagagacaagacagagattcccaccatggtcagtctgagaaacaagacagagattcccaccacagtcagcctgagagacaagacagagattctcaccacaatcagtctgagagacaagacaaggatttcagctttgatcagtcagagagacaaagtcaagactccagctctggtaaaaaagtgagtcacaaatctaccagtggccaggctaaatggcagggacatatctttgccttaaatcggtgtgaaaaaccaattcaggattctcattatggtcagtctgaaagacatacacaacaatctgaaacacttggacaagcctctcactttaaccagacaaatcaacagaaatcaggctcttattgtggacagtctgagaggctaggtcaggaattaggctgtggtcagacagacagacaaggccagagttcccactacggtcagacggacagacaagaccagagttatcattatggtcagacagacagacaaggccagagttcccactacagtcagacggacagacaaggccagagttcccactacagtcagccagacagacaaggtcagagttcccactatggtcaaatggacagaaaaggccagtgttatcattatgatcagacaaacagacaaggccagggttcccactacagtcaaccaaacagacaaggtcagagttcccactatggtcagccagacacacaagatcagagttctcactatggtcagacagacagacaagaccaaagttctcactatggtcagacagagagacaaggccagagttcccactacagtcagatggaccgacaaggccagggttctcactacggtcagacagacagacaaggccagagttcccactatggtcagccagacagacaaggccagaattcccactatggtcagacagacagacaaggccagagttcccactatggtcagacagacagacaaggccagagttcccactacagtcagccagacaaacaaggccagagttcccactatggtaagatagacagacaagaccagagttatcattatggtcagccagacggacaaggccaaagttcccactatggtcagacagacagacaaggccagagtttccactatggtcagccagacagacaaggccagagttcccactacagtcagatggacagacaaggccagagttcccactatggtcagacagacagacaaggccagagttcccactacggtcagacagacagacaaggccagagctatcattatggtcagacagacagacaaggccagagttcccactatattcaatcacagactggggaaatacaagggcaaaataagtacttccaagggactgaaggaacaagaaaagcctcttatgttgaacaatcaggaagatcagggaggctaagtcaacagactccaggacaggaagggtaccaaaaccagggacagggattccagtctagggactcacagcagaacggccaccaggtatgggagcctgaagaggatagccaacatcaccaacacaaactcttagcacaaatccaacaagaaagaccactttgtcacaaagggagagactggcaatcatgcagtagtgagcagggccacagacaggcccagaccaggcagagtcatggtgaggggctgagccactgggcagaggaagagcagggccatcaaacttgggatagacacagccatgagagtcaggaaggtccatgtgggacacaggacaggcgaacccataaagatgagcagaaccatcagagacgagacagacaaacccatgaacatgagcagagccatcagagacgagacaggcaaacccatgaagacaagcagaaccgtcagagacgagacaggcaaacccatgaagacgagcagaaccatcagagatgagacaggcaaactcatgaagaggatcaaaaccatcagcaacaacataatagacaaaactatgaggagaaagagaggtatcaaggatctcagaatcaaaaatcccaagtgacccacagaagctgtcctaacagagaaaaattccacatgaaagaggatgaccagagccaaggctcacagaaaagacacactgaaccatccttctatccaacccagagcagtgggaggccccaaaccagagaacagcgtggtcaccctgccaagggagctactgttcccaaccccccctatgactatgtgcaagagcagaaatcctacccatactaggctatgtgagcaccagaggtaaagcaacacaaagccaaaaaagaaacctatatgtcgagttcacctttaattcgatttaagagattgagaatgtatttcttccctctatcctctgctgtatctccctgcaaggatgtttttgagtactagcattcacgtaagggcttttggttctttgagcagcaattctagggttttctgattcagtgaaatctaggtggtaaattgggtgaaataatcatatcttaatgttgatcagtttgggtatttaaatcatttcctgctttgccctctgtgtagatgagacctggttgaatcattgaaaggtagaacacttctccctaaagttcagaaacagaaaagatattctgaagatttacattacatccaaggattatactacatctccactcctcaaggaaccctagatttggtgagctttggctcctgtggataaaacatcaggaatttcaagcctcatagtctagactagaatgaaactcagttcaaggctgctacaagagccgagaacatagagtgcatctctgatgtttactacatctcccatgccaggctcttattccacaccagagggactgtccattagtgcctatcactagagctgaatggacccattccaattcaatacctttctagtttctgattatataaaataaagagaaagtatatgtcatatgtttgcaaattccaggggatcaagactattgattcatagctcctaagacctgaaaactcttctcaagaaaatctatgtgcagattatgaattgtattaaaatatctaataaataattgatgagcaata

SEQ ID NO: 25926 - DNA, 2202 bp, Homo sapiens
ctatggtcaaatggacagaaaaggccagtgttatcattatgatcagacaaacagacaaggccagggttcccactacagtcaaccaaacagacaaggtcagagttcccactatggtcagccagacacacaagatcagagttctcactatggtcagacagacagacaagaccaaagttctcactatggtcagacagagagacaaggccagagttcccactacagtcagatggaccgacaaggccagggttctcactacggtcagacagacagacaaggccagagttcccactatggtcagccagacagacaaggccagaattcccactatggtcagacagacagacaaggccagagttcccactatggtcagacagacagacaaggccagagttcccactacagtcagccagacaaacaaggccagagttcccactatggtaagatagacagacaagaccagagttatcattatggtcagccagacggacaaggccaaagttcccactatggtcagacagacagacaaggccagagtttccactatggtcagccagacagacaaggccagagttcccactacagtcagatggacagacaaggccagagttcccactatggtcagacagacagacaaggccagagttcccactacggtcagacagacagacaaggccagagctatcattatggtcagacagacagacaaggccagagttcccactatattcaatcacagactggggaaatacaagggcaaaataagtacttccaagggactgaaggaacaagaaaagcctcttatgttgaacaatcaggaagatcagggaggctaagtcaacagactccaggacaggaagggtaccaaaaccagggacagggattccagtctagggactcacagcagaacggccaccaggtatgggagcctgaagaggatagccaacatcaccaacacaaactcttagcacaaatccaacaagaaagaccactttgtcacaaagggagagactggcaatcatgcagtagtgagcagggccacagacaggcccagaccaggcagagtcatggtgaggggctgagccactgggcagaggaagagcagggccatcaaacttgggatagacacagccatgagagtcaggaaggtccatgtgggacacaggacaggcgaacccataaagatgagcagaaccatcagagacgagacagacaaacccatgaacatgagcagagccatcagagacgagacaggcaaacccatgaagacaagcagaaccgtcagagacgagacaggcaaacccatgaagacgagcagaaccatcagagatgagacaggcaaactcatgaagaggatcaaaaccatcagcaacaacataatagacaaaactatgaggagaaagagaggtatcaaggatctcagaatcaaaaatcccaagtgacccacagaagctgtcctaacagagaaaaattccacatgaaagaggatgaccagagccaaggctcacagaaaagacacactgaaccatccttctatccaacccagagcagtgggaggccccaaaccagagaacagcgtggtcaccctgccaagggagctactgttcccaaccccccctatgactatgtgcaagagcagaaatcctacccatactaggctatgtgagcaccagaggtaaagcaacacaaagccaaaaaagaaacctatatgtcgagttcacctttaattcgatttaagagattgagaatgtatttcttccctctatcctctgctgtatctccctgcaaggatgtttttgagtactagcattcacgtaagggcttttggctcctgtggataaaacatcaggaatttcaagcctcatagtctagactagaatgaaactcagttcaaggctgctacaagagccgagaacatagagtgcatctctgatgtttactacatctcccatgccaggctcttattccacaccagagggactgtccattagtgcctatcactagagctgaatggacccattccaattcaatacctttctagtttctgattatataaaataaagagaaagtatatgtcatatgtttgcaaattccaggggatcaagactattgattcatagctcctaagacctgaaaactcttctcaagaaaatctatgtgcagattatgaattgtattaaaatatctaataaataattgatgagc

SEQ ID NO: 25927 - DNA, 1695 bp, Homo sapiens
ggggcttgcgtggcggcgtcaaggggcggtgcctcgggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacat

SEQ ID NO: 25928 - DNA, 1576 bp, Homo sapiens
gcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggcaataa

SEQ ID NO: 25929 - DNA, 2402 bp, Homo sapiens
tttacgcggccgcgaccggtagtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataaagttgctgtgaata

SEQ ID NO: 25930 - DNA, 1461 bp, Homo sapiens
agtgacgtcacgagatttggagctcgcgggaaaacttgtctctgcgttgtggggaggacgcgcgctcgcgcgggattttcaagcgtaggcccccgggaactcgagctgccatgagcctctgggtggacaagtatcggccctgctccttgggacggctggactatcacaaggagcaggcggcccagctgcggaacctggtgcagtgtggtgactttcctcatctgttagtgtacggaccatcaggtgctggaaaaaagacaagaattatgtgtattctacgtgaactttatggtgttggagtggaaaaattgagaattgaacatcagaccatcacaactccatctaaaaaaaaaattgaaattagcaccattgcaagtaactaccaccttgaagttaatcctagtgatgctggaaatagtgaccgagtagtcattcaggagatgttgaaaacagtggcacaatcacaacaacttgaaacaaactctcaaagggattttaaagtggtattattgacagaagttgacaaactcaccaaagatgctcagcatgccttgcgaagaaccatggaaaaatatatgtctacctgcagattgatcttgtgctgcaattctacatctaaagtgatcccacctattcgtagtaggtgcttggcggttcgtgtgcctgctcccagcattgaagatatttgccacgtgttatctactgtgtgtaagaaggaaggtctgaatcttccttcacaactggctcatagacttgcagagaagtcttgtagaaatctcagaaaagccctgcttatgtgtgaagcctgcagagtgcaacaatatccttttactgcagatcaagaaatccctgagacagattgggaggtgtatctgagggagactgcaaatgctattgtcagtcagcaaactccacaaaggctccttgaagttcgtggaaggctgtatgagcttctaactcattgtattcctcctgagataataatgaaggcatgtaaggaggaatcaagaagctgtgacatattctgaggacctccaaagaacaacttgctactgactggacttctctcatcttttagcatgtgaagttttgcaaatataatccactttgctctgaatgtcctgacacctgcttcagagctcaagattcagactccagcctgaatgttatttcctgagaaaatccctccctgacccactgtgctggttaggtccacctgctaatcacatccacaaaaccctctgcttctccttcaaaacactcatctcctctgtaatgatcagatgaactcatgtctttctcagaggacaataaatttgatgaatggggaccatggaagtttatttccatctgtatccctacatctaactcatctgctggtacctatttgtcatgtatttaataagtacaactacctatgccaccctgcaataaaatgatattgttactttctcttcttta

SEQ ID NO: 25931 - DNA, 1384 bp, Homo sapiens
accggcgtattcccgccctgcttttcgcccgccgttccgtggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagca

SEQ ID NO: 25932 - DNA, 1448 bp, Homo sapiens
cgcgctcacgtctgaagtgggagcaatgcaccgggacagggacacctcctaggccatgcctgttccagtccagttctgcctgaaagtccggctggctcatcacctgcctaaataaaaccgtatacgggcaaactccctccgcaagcagcgcgccccagcaccggaagtgacgcgttacgtgcccgcgtattcctaccggcgtattcccgccctgcttttcgcccgccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgaatatatctggatggggggttttgtaaataatgaagttgtaataaaaataaaatgaccaaaagcaccttt

SEQ ID NO: 25933 - DNA, 560 bp, Homo sapiens
agatttctaagtggggctcaggaattataatagatgtccacagctgcatggtcttctctctccacaacacgcagacactattagaagtaaaagccacgtgtcctcaagagggcaaggcaaagcatcttcagatgtctctgcccttaaagcacacgcgttctgctctgcgacgaagcaggacaaggaggacagggacctgcacctccggaggcccgcacctacgaagatagcgggctcgggaccttcggtggaccggcagggttccagaggcccgcgcgccgccgccccgccctcattgctgagcctgccagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaata

SEQ ID NO: 25934 - DNA, 701 bp, Homo sapiens
gccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattg

SEQ ID NO: 25935 - DNA, 485 bp, Homo sapiens
tttgtatcgcggaaacctgaggaacgagccggcggcggtgacctgcacgagaagccaggctaactgagtcccccaccttcccttccccacagaaagtctctgaagggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtg

SEQ ID NO: 25936 - DNA, 785 bp, Homo sapiens
cgcgctcacgtctgaagtgggagcaatgcaccgggacagggacacctcctaggccatgcctgttccagtccagttctgcctgaaagtccggctggctcatcacctgcctaaataaaaccgtatacgggcaaactccctccgcaagcagcgcgccccagcaccggaagtgacgcgttacgtgcccgcgtattcctaccggcgtattcccgccctgcttttcgcccgccgttccgtggcgggaactgaggcgactgtggggacatcagtgatcggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatgga

SEQ ID NO: 25937 - DNA, 453 bp, Homo sapiens
tcctttattatgtaacatctttgcacaaggctaagtttattttcgggctgtactttctcataatggttccccaccaccacccccgctttcctatggtgctgattcgcaataaaagtttcaataaaagctttttttttctgtcttgcacctgaccagggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactct

SEQ ID NO: 25938 - DNA, 2229 bp, Homo sapiens
gagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagagggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttcttt

SEQ ID NO: 25939 - DNA, 2442 bp, Homo sapiens
gaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagaggcgagctaccaagcccatcctgtaaccattttaaaatgtacaattcagtggcattaagtacattcagaatgcagtgtactgttgtggagtcttcccgctatctagttccaaaatttcatcaccccaaatggaaatcctttacccattgacagttactccccattctccccttcctctagcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctg

SEQ ID NO: 25940 - DNA, 559 bp, Homo sapiens
agagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatg

SEQ ID NO: 25941 - DNA, 1655 bp, Homo sapiens
gcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggctccatggtcttggagctgaatgcttcagatgaccgaggaatagacatcattcgaggaccgatcctgagctttgctagcacaaggacaatatttaagaaaggctttaagctagtgatcttggatgaagcagacgccatgactcaggacgcccagaatgccttgagaagagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaaagttgatataagtgaagatggaatgaaagcactagtcactctttccagtggagacatgcgtagggctctgaacattttgcagagcaccaatatggcctttgggaaggtgacagaggagactgtctacacctgcaccgggcacccgctcaagtcagacattgccaacatcctggactggatgttgaatcaagatttcaccacagcctacagaaatattacagagttgaaaactctgaaggggttggcactgcatgatatcctgacagagatacacttgtttgtgcatagagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttac

SEQ ID NO: 25942 - DNA, 574 bp, Homo sapiens
aagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctgagacagggtctcgctctgtcgcccatgctggagcgcagtggtgtgatcacagctcagtgtaacctcaaacattggggttcaagccattctcctgcctcagcctccgaagaactgggacttttagaggcgagctaccaagcccatcctgtaaccattttaaaatcccctggcaaccactaatctgctttctatctatggatttgcctattctggacatttcatggttgaaaaataccggccacagaccctgaatgatctcatttctcatcaggacattctgagtaccattcagaagtttatcaatgaagaccgactgccacacttgcttctctacggtcccccagggacaggcaagacatctaccatcctagcctgtgcgaaacagctatataaagacaaagaatttggct

SEQ ID NO: 25943 - DNA, 1237 bp, Homo sapiens
gttctgtggttttccgctattcccccagacccgcaccttctcggcctctttgcggagaatcgtgaccaagatgtggaacagtaatgatgggggtgcggggtggaggaggaagagaatcgcaggaggttttagcaagagggcgagcctagggtccgagaggcgtgtggtagcgggagaggaagggcgggagcggagctggggcgtttgggggtcacccgcaggaaggcggcgaggaaggttagggagactcgggcagtgtttgaaggggcgaagcctccgggagcctgcgggtttctcggaggcgtgggacgtggcacaggcactaatcctgttgttcaaaacaggtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccaggggg

SEQ ID NO: 25944 - DNA, 1162 bp, Homo sapiens
gctagtgcggagggttttgcccttcgtaaagatggccgcggaggcttttggagccaactgggagcgcagtacgcgttttctggagcatgggcagaggagacaggaacaagcgtagcatccgtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaa

SEQ ID NO: 25945 - DNA, 1752 bp, Homo sapiens
agtgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaa

SEQ ID NO: 25946 - DNA, 554 bp, Homo sapiens
ctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactggaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgta

SEQ ID NO: 25947 - DNA, 682 bp, Homo sapiens
gactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtaatgatgggggtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccag

SEQ ID NO: 25948 - DNA, 1540 bp, Homo sapiens
ctagtaaaaatgcatttttatagagatgttgggaaaggcttgcttgaaattacacgtgggacttttaatagataggcgctttgaccagctaagcaacagggctcccctcgtgtgggacttttagaatgtagcaaccactgacacacagggaaggattatgcgatcaggtgagaaggtggccgaccctgactggctggaagcagatgcattctggtagttgattggtccacaggtagcgtgacgcttgtcacgtcctcagcctcccagcattcaatcgtagcctttcggacagctcgaagccttctgtggagagctcgaagccttctgtggagaactcaaagccgtccgtggagccccagacgagccaaagcccaccttctcctcagcctgagctgtcttgaagatgagtaagagtgggtttgggagctatggcagcatttctgctgctgatggagcgagtggaggcagtgaccaactgtgtgagagagatgcaactcctgctattaagacccaaagacctaaggtccgaattcaggacgttgtaccgtgtaatgtgaaccagcttctcagctctactgtgtttgaccctgtgttcaaggttaggggaattatagtttcccaggtctccatcgtgggggtaatcagaggggcagagaaggcttcaaatcacatttgttacaaaattgatgatatgaccgcgaaaccaatcgaggcccgacagtggtttggtagagagaaagtcaagcaggtgactccattgtcagtcggagtatatgtcaaagtgtttggtatcctcaaatgtcccacgggaacaaagagccttgaggtattgaaaattcatgtcctagaggacatgaacgagttcaccgtgcatattctggaaacggtcaatgcacacatgatgctggataaagcccgtcgtgataccactgtagaaagtgtgcctgtgtctccatcagaagtgaatgatgctggggataacgatgagagtcaccgcaatttcatccaggacgaagtgctgcgtttgattcatgagtgtcctcatcaggaagggaagagcatccatgagctccgggctcagctctgcgaccttagcgtcaaggccatcaaggaagcgattgattatctgaccgttgagggccacatctatcccactgtggatcgggagcattttaagtctgctgattgaggcagggaaaacatcctttcatttttcgaagacccttgcatccagctgtgagtaattttgacctgttgactttttaggaagtaggactaaaaaaaaaaatctcaagtggcattctttgtcaactcgctgcttttctaactgctttgaacttttcggattttctgtatttgaagctcagagagagacggtgatggataaattgacaactctgtaggatttactagcaagctaatggaaacatgattttcggggaagaaaaactacagaaaatgtagaaatttattatttaattgtgttggagcttctttttccaaaagaaaaactagttgcagtcagggagccagcgaaaag

SEQ ID NO: 25949 - DNA, 1471 bp, Homo sapiens
gcgagcgccgggaacgagcaccaccagggctggagcggacggctttagaagagcctagctgctgcgcgcgtcggagaggctcctgggaaactcccacggcccagggactttcgaaagcagagcgaggagccctcgcacgcgctagtctgcgagtgagcgctcagcccggcacctgttcctccagcgccgccgccttcccacccctcggacccgcgccgctcgcggcgcccgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttctccacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttt

SEQ ID NO: 25950 - DNA, 478 bp, Homo sapiens
gtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggcctggagtgccagagcgtcacctccaggggggacctggctacttgcccccgaggcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctgaggtcgcgcgcagcgcgtgcacagcgcgggcggaggcggctccaggtccggaggggttgcgggggagctggaaataaacctggagatgatgatgatgatgatgatg

SEQ ID NO: 25951 - DNA, 249 bp, Homo sapiens
atgaaagctctctgtctcctcctcctccctgtcctggggctgttggtgtctagcaagaccctgtgctccatggaagaagccatcaatgagaggatccaggaggtcgccggctccctaagcttcgccgtcaccggctgcacttgtggctccgcctgtggctcgtgggatgtgcgcgccgagaccacatgtcactgccagtgcgcgggcatggactggaccggagcgcgctgctgtcgtgtgcagccctga

SEQ ID NO: 25952 - DNA, 1496 bp, Homo sapiens
gccgtgtcactggctcaggctcagttgctgggtcaccagtagaatggacccttcctccacctcagttcagagcacagtgatgattcgtgactttctttcccaatagaacttcaaatctctgaagacggggggtggggggatgtgcttgagtgtttgtactcatggtcttgttctagaagtgacaaagctgggacacaatacctttatgcatgaaaaggttgtcacttgtcacaactaacaggctttcacctcacggaaattttcttcccttgtgcacttttcccctggcagtggacatggctgcactcttccaagaagcaagcagctgtcccgtctgctcagactatctagagaaaccaatgtccctggagtgtggatgcgctgtctgcttcaagtgcatcaattcactgcagaaggagccccatggggaggatctactttgctgttgctgttccatggtctctcagaagaacaaaatcaggcccagttggcagctagagaggctggcttcccacatcaaggaactggagcccaagctgaagaagattctgcagatgaacccaaggatgcggaagttccaagtggatatgaccttggatgccgacacagccaacaacttcctcctcatttctgacgacctcaggagcgtccgaagtgggtgcatcacacagaatcggcaagaccttgccgagagatttgacgtgtccatttgcatcctgggctcccctcgctttacctgtggccgccactactgggaggtggacgtgggaacaagcacagaatgggacctgggagtctgcagagaatctgttcaccgcaaagggaggatccatctgaccacagagcgtggattctggactgtgagtttgagggatggaagccgcctctctgccagcacggtgccgctgactttcctcttcgtagaccgcaagttacagcgagtggggatttttctggatatgggcatgcagaacgtttccttttttgatgctgaaggtggttcccatgtctatacattcaggagtgtctctgctgaggagccactgcacttgttttttgctcctccaagtccacctaatggtgataagagtgtcttgagtatctgtcctgtgataaacccgggcactactgatgctccagtccatcctggggaggccaaataagcccccactgcaaaaaaacaaaaaacaggttaagaaaattacttgggtgggcagacttaggaacgctctactcggtaaaagcgttatacaaagtcataggagaaaaatatgggacaattcatgattatacttaatctaatttgattagtttataaattgagtcctaagtattaattattgccaccatccaactcattgagtcttatggttcacatcttgtttcctatagaaatattctgtattctgggatcaatttccaaatgcttttttatttctgtaagttcaaattaatgtattatagaagttatgagttaaataaacattggaatatca

SEQ ID NO: 25953 - DNA, 1496 bp, Homo sapiens
gccatgtcactggctcaggctcagctgctgggtcaccaggagaatggacgcttcctccacctcagctcagagcacagtgatgattcgtgactttcccaatagaacttcaaatctctgaagacggggggtggggggatgtgcttgagtgtttgtactcatggtcttattctcggagtgacaaagctggaacacaatacctctatgcatgaaaaggttgtcacttgtcacaactaacaggctttcacctcatggaaatttttttaccttgtgtacttttcccctggcagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcacct

SEQ ID NO: 25954 - DNA, 1452 bp, Homo sapiens
gccagcccatctgctccatgcccaggcttttctggctttgtctgcccggatgcccagtgccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcacct

SEQ ID NO: 25955 - DNA, 2410 bp, Homo sapiens
tatcgctacactgccgcggcgagtaccgggttggcggcgctatcctgggctacaccgccggtggcgggaggcgttttaggggcgctatctggtgctgcactgcccgcgcaggagttgggttgggtgacctactccaggcgtcactgcccgaggctgggggctgatttggggcgctatcccgggagtcatttcctgtggcgaggggctggttgagggtggtatccgtggctgcactgcccacagcacagagcgggtttggggagttatcccgggctgcgctgcccgtggcagggggcaggctgccagcgccattgggtgctgcatgtactaggcacggatgagttaggggcgccatctgggactgcactgccggtggcgggcggtggaggtgtcagtgacagcggtggtctgcaagagaggagcggtcctcctcttcccggccacctcctcctgttcttgctcaagtgcggcgggcgcacagcatttcctgagcgcggcaggggccccagccccgtggtgcttcctggacccgcctcctattgctctgtgttgcagagaccgcctgggaccccggggcacgcagtagtggacacgaggaggctacagggccctgtgggtggaggaggcatcaggaacgggaaccggcacttgggtggggagggctggctggggttgagtttctgctgctcctgcttcccgaggagtgcagccagggtggctgcagctgttcctgtggagtgggaagcccgggcactgtggtgtctgcagtccccactccaggccgcagttcctggccagcttgcgctaaaaggagaggctggactttgaagtgtgggtgcttttctggctttgtctgcccggatgcccagtgccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcacct

SEQ ID NO: 25956 - DNA, 2407 bp, Homo sapiens
tatcgctacactgccgcggcgagtaccgggttggcggcgctatcctgggctacaccgccggtggcgggaggcgttttaggggcgctatctggtgctgcactgcccgcgcaggagttgggttgggtgacctactccaggcgtcactgcccgaggctgggggctgatttggggcgctatcccgggagtcatttcctgtggcgaggggctggttgagggtggtatccgtggctgcactgcccacagcacagagcgggtttggggagttatcccgggctgcgctgcccgtggcagggggcaggctgccagcgccattgggtgctgcatgtactaggcacggatgagttaggggcgccatctgggactgcactgccggtggcgggcggtggaggtgtcagtgacagcggtggtctgcaagagaggagcggtcctcctcttcccggccacctcctcctgttcttgctcaagtgcggcgggcgcacagcatttcctgagcgcggcaggggccccagccccgtggtgcttcctggacccgcctcctattgctctgtgttgcagagaccgcctgggaccccggggcacgcagtagtggacacgaggaggctacagggccctgtgggtggaggaggcatcaggaacgggaaccggcacttgggtggggagggctggctggggttgagtttctgctgctcctgcttcccgaggagtgcagccagggtggctgcagctgttcctgtggagtgggaagcccgggcactgtggtgtctgcagtccccactccaggccgcagttcctggccagcttgcgctaaaaggagaggctggactttgaagtgtgggtgcttttctggctttgtctgcccggatgcccagtgccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagcctcatcaggttagagggtgtggaagggcgtgacccagtgggaggtgggaatctcaccaataaaaggccctcgtgtgccccttccccacaagacctgagcgcccagtggaagcagctggaggacagaggagcttccagcagaagagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctactttgctgttgctcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccaccacggtgccgctgactttcctcttcgtagaccgcaagttacagcgagtggggatttttctggatatgggcatgcagaacgtttccttttttgatgctgaaagtggttcccatgtctatacattcaggagcgtatctgctgaggagccattgcgcccatttttggctccttcagttccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattgtacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatca

SEQ ID NO: 25957 - DNA, 1488 bp, Homo sapiens
gccacgtcactggctcaggctcagctgctgggtcaccaggagaatggacccttcctccacctcagctcagagcacagtgatgattcgtgactttcccaatagaacttcaaatctctgaggacggggggtggggggatgtgcttgagtgtttgtactcatggtcttgttctcggagtgacaaagctggaacacaatacctctatgcatgaaaaggttgtcacttgtcacaactaacaggctttcacctcaaggaaattttcttcccttgtgtacttttcccctggcagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 25958 - DNA, 1203 bp, Homo sapiens
agtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 25959 - DNA, 1214 bp, Homo sapiens
cggcagcagcgagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 25960 - DNA, 4097 bp, Homo sapiens
ccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaat

SEQ ID NO: 25961 - DNA, 5659 bp, Homo sapiens
ccctacccgctcctccggcgcagccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataaaa

SEQ ID NO: 25962 - DNA, 2189 bp, Homo sapiens
ccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctg

SEQ ID NO: 25963 - DNA, 1327 bp, Homo sapiens
gcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagc

SEQ ID NO: 25964 - DNA, 2076 bp, Homo sapiens
agaaacccgacggcgcggacccaacctggctgctgcagtacttgctctaactttgccgcagctgcctcccttctctcggaacccactctcctaacccacccccgagaggcggagagaatgtgggagcacttcagagaggcctaggctccggagatcgggccatctgggctctgaaagcaaattagttttccaactcatgtctggctccggcgttacccagacgcctggaaggtccttcctgcagtctgatcaccatttttcctgctgcactgaccaatcagctccccttggccttcaacctcgggaatgatggattaggggagtctagaaatggacgaagccctagaaacgcagctgaagacgagcagaggacgcttctcggctacagaatccctccccaccttggagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacaggctggagtgcagtggcgcgatctcagctcgatgcaacctccgcctccggggttcaagtgattctcctgccgcaacctcccgaatagctgggatttcaggcgcatgccaccatgcccagctaatttttgtatttttagtagagtcagcgtttcaccatgttggccaggctggtttcgaactcctgacctcaggtgatccgcccacctcggcctcccaaagtgttgggattacaggtgtgagccaccgcccccggcccccaccaagttctttcttaccgtgtctagaccccagagaccggattggtactccccaggtccctgctcccacccttccctagcccaacctcctactgggttgtgccctttgaccccaaaagctctcgaagtccagatttgcccttcccaagaaaccattcctgctctgggtccatccacattttaccctggaggacccagaagcccagtcactctctacaaaaccccagccttgatacagacctctctgcgcgccccccaactgccccaaccctgattcatcccgctagggcccagtaagaacattcaccctccccaaggacctgcccccactcacgttccgcacatagactcccaggccgcacgctccggctctgaccccaatccctaaggaatttacacatttttcccttcccgaggccacgccccccacgtctctggactccgcccactagggccttaactccactttttcctagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagcacgt

SEQ ID NO: 25965 - DNA, 1043 bp, Homo sapiens
ggaggccgcatagaagagagggaggaattactgaacaggagagggggattggaagacctagggaggtccccttcattctgagaaaagaaggggtctcttgaagactaaaaagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagc

SEQ ID NO: 25966 - DNA, 2076 bp, Homo sapiens; identical to SEQ ID NO: 25964

SEQ ID NO: 25967 - DNA, 1024 bp, Homo sapiens
gtagtggaggaggtggaatgaagagtgagaaagctgtctaggtgcctgtccaattagggcagtaggaagaatcctgatggccaggcagctcttatctcaggtggacatggactgcagggtccacatgcgacccatcggcctgacgtgggtgctgcaactgaccttggcatggatcctgctagaagcctgtggagggagccgcccactccaagccaggtcccagcaacaccatgggctggcagctgatctgggcaaaggcaagctgcacctggcaggaccttgttgtccctcagagatggacacaacagagacatcgggccctggaaaccatccagaacgctgtggagtgccgagccctgaatgcgaatccttcctggaacacctccaacgtgcccttcgcagtcgcttccgcctgcggctattgggggtacgccaggcacagccgctctgcgaggagctctgccaggcctggttcgccaactgcgaagatgatatcacctgcggcccgacttggctcccactctcagaaaaaaggggctgtgagcccagctgccttacctatggacagaccttcgcagacgggacggacctttgtcgctcggctctgggccacgccctaccggtggctgctcctggagcccgtcactgcttcaacatctccatctccgcggtacctcgtcccagaccaggacgacggggccgggaagctccctcccggcgttcccgcagccctcgcacctccatcctggacgctgcgggcagcgggagtggcagtggaagcggcagcggcccctagcggacgcgtggccctgagttgggggagcgacccttcccccagccccgcccctcaggacacccagaaccccacccctcgtcctctcggccttctgtaatagttttgagatgtctgtccctcctccctggagctccagagacccacccctctccaggttatcccagaaatgacccaactctctcacttttccctctcccctttgaataaagtcgccagctagagcacgtg

SEQ ID NO: 25968 - DNA, 2572 bp, Homo sapiens
agccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcatgcacaggctgaggccaggcatctggtatatgaatcagacaaaaacaaggatgagaagctaactaaagaggaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatc

SEQ ID NO: 25969 - DNA, 549 bp, Homo sapiens
gaaatattggagaactggaacatgtttgtcggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttgtgatcactgattagaatgagttggtgggatccttgggaagccaaacggagcggagttctggatcatgtcccatccagtccagtgaatccacgacccgcagacctgtccccccgcaacagcttataccatggaatgaggacaaggtgatactctgagctgtggactgaactggcagacacaacctgtacagattgaaatttcaccttgtaaggaggaagtgaatgaaataaaggatccccctaagga

SEQ ID NO: 25970 - DNA, 2215 bp, Homo sapiens
atataggcctcctcctggcgcgcctccgcaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggctgctgctgctgtgcgccgccgcggccggcgccggcaaggccgaggagctgcactacccgctgggcgagcgccgcagcgactacgaccgcgaggcgctgctgggcgtccaggaagatgtggatgaatatgttaaactcggccacgaagagcagcaaaaaagactgcaggcgatcataaagaaaatcgacttggactcagatggctttctcactgaaagtgaactcagttcatggattcagatgtcttttaagcattatgctatgcaagaagcaaaacaacagtttgttgaatatgataaaaacagtgatgatactgtgacttgggatgaatataacattcagatgtatgatcgtgtgattgactttgatgagaacactgctctggatgatgcagaagaggagtcctttaggaagcttcacttaaaggacaagaagcgatttgaaaaagctaaccaggattcaggtcccggtttgagtcttgaagaatttattgcttttgagcatcctgaagaagttgattatatgacggaatttgtcattcaagaagctttagaagaacatgacaaaaatggtgatggatttgttagtttggaagaatttcttggtgattacaggtgggatccaactgcaaatgaagatccagaatggatacttgttgagaaagacagattcgtgaatgattatgacaaagataacgatggcaggcttgatccccaagagctgttaccttgggtagtacctaataatcagggcattgcacaagaggaggcgcttcatctaattgatgaaatggatttgaatggtgacaaaaagctctctgaagaagagattctggaaaacccggacttgtttctcaccagtgaagccacagattatggcagacagctccatgatgactatttctatcatgatgagctttaatctctgagcctgtctcagtagagtactggctccttttataatttgttaccagctttacttttgtgataaaatattgatgttgtattttacactcttaagtcttaaccacagtcagaattatcttaatgtagattataattttggtcttttaggaaaaaaaaacaaaaatctgatatttatttcaaaatgtattgaagcaacaaaatattaatattgtgccatatgacaacaaagtctttcctaaatactccatctgtttagtactgtattgtggaatatttgagttctatttccatacttgaaaacatggaggattttagagatgcctgaacaatattatttaagtagtatgtgaccgagctataaatttttgtttttgttctaagtagatttaatttgggaactgacaggacaatgtttttaggtttagcattttgtttaaaaacctttaaagaaacctttagaaggacttagacctcacatattaatgttgagaagttctgcttaattttaaaatggtttctataaagggttttattgtatgaaatagaactttatatttttgcatatgtatagatagtaattatatttaatgtataactatagcattatggtgagtggaatttgacattgtccaaacctttttcatttttgagtgattaaaaatgaaatgtcctttgtatatgtttgtttgcttttctttaactttcagataaatattgaatttagcataggttttgtggtattgtacattatcttgcctcatccattcctttatgtggatagttcccaaaactgtcaaattattcttgctgcattttcttattttttttttaaataagagaatcatgttataatataattgaatgtgcacctgacacattttaataattggtgttgtagcaaatgtggttttgctctttggggctataaataatcttgagtaacgcaggttggaattaccaatagagctggtcagttatcaacagtagagctcagtatcaattttactgaaattaaaatcatacttgataagca

SEQ ID NO: 25971 - DNA, 3435 bp, Homo sapiens
aggaggacccggaccaagcaggccattttcacctgcgtaataacaggattgggaatagcgaagcagcggcggcagcagcgagtggagtaggaggaggagcgcaggcagcggccgcggcggggccggaggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 25972 - DNA, 1703 bp, Homo sapiens
agaaccgctttacccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgt

SEQ ID NO: 25973 - DNA, 2130 bp, Homo sapiens
cgtgtgtgtgcctccgtggctctccttcgctctgtgggacgacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgtt

SEQ ID NO: 25974 - DNA, 2647 bp, Homo sapiens
ctgagacaccgcagcttccctgagcgccgagtccctccggggacagcagcagggagcgcccgcgcagccaccgagcctctgcccagccaagccgccgtcgccgcgccggtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcatgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttgg

SEQ ID NO: 25975 - DNA, 2282 bp, Homo sapiens
cgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctaggaacagctatggaatggttaaagacatcattgcttttggctgtttacaagacggttccaattttggaattgtccccacctctgtggacagccattggctgggtccaaaggggccccaccccccctactcctgtcctccgggttctactgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacc

SEQ ID NO: 25976 - DNA, 2065 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcgcccactgcaaagaagctccgtctacagcctcctcaactcctgattccacagaaggagggaacgacgactctgattttcgagagctgcacacagcccgggaattctcagaggaggacgaggaggagaccacgtcgcaggactggggcaccccccgggagctgaccttctcctacatcgcctttgatggtgtagtgggctccgggggccgcagggattcaactgcccgccgcccccgcccccagggccgctcagtctcggaaccacgagaccagcaccctcagcccagcctgggcgacagcttggagagcatccccagcctgagccaatccccggagcctggacgacggggtgatcctgacaccgcgcctccatccgagcgccctctggaagacctgaggcttcggttggaccatctgggctgggtggcccggggaacgggatccggggaggactcttccaccagcagctccaccccgctggaagacgaagaaccccaagaacccaacagattggagacaggagaagctggggaagaactggacctacgactccgacttgctcagccctcatcgcccgaggtcttgactccccagctcagtccgggctctgggacaccccaggccggtactccgtccccatcccgatcgcgagattcgaactctgggcccgaagagccattgctggaagaggaagaaaagcagtgggggccactggagcgagagccagtaaggggacagtgcctcgatagcacggaccaattagaattcacggtggagccacgccttctagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacc

SEQ ID NO: 25977 - DNA, 1078 bp, Homo sapiens
ccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgcacttggctctgttgctgctctgcggcaccatctctctcagggtttaccgcaaagtgctgcaggccgtgcaccggggggatggagccaaccctttccaggcctacctggatgtggacctcaccctgactcgggagcagacggaacgtttgtcccaccagatcacctcccgcgtggtctcggcggccacgcagctgcggcacttcttcctggtagaagacctcgtggattccctcaagctggccctcctcttctacatcttgaccttcgtgggtgccatcttcaatggtttgactcttctcattctgggagtgattggtctattcaccatccccctgctgtaccggcagcaccaggctcagatcgaccaatatgtggggttggtgaccaatcagttgagccacatcaaagctaagatccgagctaaaatcccagggaccggagccctggcctctgcagcagccgcagtctccggatccaaagccaaagccgaatgagaacggtgtctctgcccgcaggacgcctgcccccagcccccgcagccctctggccccctccatctcttgtccgttcccacccacccccctcctcggcccgagccttttcccggtgggtgtcaggatcactcccactagggactctgcgctaattacctgagcgaccaggactacatttcccaagaggctctgctccaggagtccaggaaagacgaggcaccttggccgcggggcctgctgggacttgtagttgcctagacagggcaccaccctgcacttccggacccgccgctggaggcgccgtgaggcgttggtgtctcctggatgctactagccccaacgccggggctttgcatggggcccaggggaggcctgagcttggatttacactgtaataaagactcctgtggaaaacc

SEQ ID NO: 25978 - DNA, 4886 bp, Homo sapiens
gctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaa

SEQ ID NO: 25979 - DNA, 2524 bp, Homo sapiens
gtgcgcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaaggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaa

SEQ ID NO: 25980 - DNA, 1407 bp, Homo sapiens
ttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgtt

SEQ ID NO: 25981 - DNA, 2619 bp, Homo sapiens
gcatgcgcgctcgcgctcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtatt

SEQ ID NO: 25982 - DNA, 4937 bp, Homo sapiens
gctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagagggattgagctctctttgctctgatgagccatcttcagaaattatgacttcttcctttctttcatcttctgaaatacataacactggccttacaatactacatggagaaaaaagccatgtgttagggagccagcctattttagccaaagaaggaaaagaccacttggatcttctagatatgaaaaagatggaaaagcctcaggggaccagcaacaacgtatcagactcttcagtttctcttgcagcaggagttcattgtgaccgtccttctattccagccagtttcccagagcatcctgcttttctctcaaagaaaattggtcaagtggaagagcaaatagataaagagaccaagaacccaaatggggtatcaagtagggaggctaaaactgcattggatgctgatgacagattcactttgctgacagcccagaaaccacctactgagtactctaaggtagaaggcatttatacatattctttgtctccatccaaagtttcaggagatgatgttattgaaaaggattcccctgaatcaccatttgaagtaattattgacaaagcagcatttgacaaagaatttaaagactcatataaggagagcacagatgattttggtagctggtctgtgcacactgataaagaatcatccgaagacatttcagagactaatgacaagctttttccactgagaaataaagaggcaggacgttacccaatgtctgcattgctcagtaggcagttttcacacacaaatgcagcactggaagaggtgtccagatgcgtgaatgatatgcataactttactaacgaaatactgacttgggatctggttccccaagtgaaacaacagaccgataaatcttctgactgcatcacaaaaactacaggacttgacatgagtgaatataattcagaaattccagttgtaaatcttaaaactagcactcatcagaaaactcctgtatgttctattgatgggagcactcccatcactaaatcaacaggtgattgggcagaagcatctctccagcaagaaaatgctattactggaaaacctgtacctgactctttgaattccacaaaagaattcagtatcaaaggtgtgcaaggcaatatgcagaaacaggatgacacacttgcagaattacctggatctccacctgagaaatgtgactctttgggttctggagtggccacagtgaaagtggttttacctgatgaccacctgaaagatgaaatggactggcagagctctgcattgggagaaatcacagaagctgatagttctggtgagtctgatgacacagtaatagaggacatcacagcagatacatcatttgaaaataacaaaattcaggctgaaaaacctgtttccattccaagtgctgttgtaaaaacaggtgaaagagaaatcaaagagattcccagttgtgagagagaagaaaaaacatctaaaaactttgaagaattggtcagtgactctgagctgcatcaagatcagcctgatattcttggaaggagtccagctagtgaggcagcatgttcaaaagtacccgatacgaatgtctccttagaagatgtgagtgaagttgctcctgaaaagcctattactactgagaaccccaaacttccttcaacagtgtctccaaatgtttttaatgagacagaattctcattaaatgtgacaacatctgcctatttggagtcattacatgggaaaaatgttaaacatatagatgattcctccccagaggacctgatagcagcctttacagaaaccagagataaaggaatagtagatagtgaaagaaatgcttttaaagcaatatcagagaagatgacagactttaaaacaactcctcctgtagaagtcttacatgaaaatgagtccggtggttctgaaattaaagacattggaagcaaatacagtgaacaaagcaaagaaacaaatggaagtgagcctctaggtgttttccctacccaaggtactccagtagcatctcttgacttagaacaagaacagctcacaattaaggctcttaaagaattaggtgaaagacaggttgagaagtcaacttctgcacagcgtgacgcagaattgccttctgaagaagtactgaagcaaactttcacatttgctccagaatcttggccacagagatcatatgacatcctagaacgtaatgtcaagaatggatctgatcttgggatttcccagaagcccatcactatcagagaaactactagggtagatgctgtttccagccttagcaagactgaattggtaaaaaagcatgtcctagcaagacttctgacagacttctcagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacac

SEQ ID NO: 25983 - DNA, 992 bp, Homo sapiens
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaactggctgtcttcatgtggctgatgacctatgttggtgctgtttttaacggaatcacccttctaattcttgctgaactgctcattttcagtgtcccgattgtctatgagaagtacaaggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgt

SEQ ID NO: 25984 - DNA, 2532 bp, Homo sapiens
agtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggatttttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacac

SEQ ID NO: 25985 - DNA, 2333 bp, Homo sapiens
gctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25986 - DNA, 4790 bp, Homo sapiens
gctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25987 - DNA, 3225 bp, Homo sapiens
atggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagct

SEQ ID NO: 25988 - DNA, 4110 bp, Homo sapiens
ctcctcctgtgctcgtggggagctggccgagtggaaaacgtccacattgacccaaccgcagtgaagggagagcgcctccagtggtgtggtgcgtggagaaatgggaaggagagagttctgatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25989 - DNA, 2390 bp, Homo sapiens
gctggcctcactcctagctcatctgggcggcggcggcaagtggggacagggcgggtggcgcatcaccggcgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagccatggaagacctggaccagtctcctctggtctcgtcctcggacagcccaccccggccgcagcccgcgttcaagtaccagttcgtgagggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggatgagaccctttttgctcttcctgctgcatctgagcctgtgatacgctcctctgcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25990 - DNA, 1896 bp, Homo sapiens
tcttttggtagcctgccctctccctgcaaatgcagctccatttggtatgagcaacaaggcaaatgcctaaaacaatcaacagatagaaggaaagcattaatgctggagtattagtagcctagttacagattgcactgcgtcagactgttccacacccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25991 - DNA, 4161 bp, Homo sapiens
agtccctgccctcccctggggagggtgagtcacgccaaactgggcggagagtccgctggcctcactcctagctcatctgggcggcggcggcaagtggggacagggcgggtggcgcatcaccggcgcggaggcaggaggagcagtctcattgttccgggagccgtcaccacaatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25992 - DNA, 1456 bp, Homo sapiens
cacaaccgcccgcggctctgagacgcggccccggcggcggcggcagcagctgcagcatcatctccaccctccagccatggagcccgaggacgaggaggaagaagaggaggaggaagaggaggacgaggacgaagacctggaggagctggaggtgctggagaggaagcccgccgccgggctgtccgcggccccagtgcccaccgcccctgccgccggcgcgcccctgatggacttcggaaatgacttcgtgccgccggcgccccggggacccctgccggccgctccccccgtcgccccggagcggcagccgtcttgggacccgagcccggtgtcgtcgaccgtgcccgcgccatccccgctgtctgctgccgcagtctcgccctccaagctccctgaggacgacgagcctccggcccggcctccccctcctcccccggccagcgtgagcccccaggcagagcccgtgtggaccccgccagccccggctcccgccgcgcccccctccaccccggccgcgcccaagcgcaggggctcctcgggctcagtggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagct

SEQ ID NO: 25993 - DNA, 4102 bp, Homo sapiens
atacggacgccagctgcgggcaaggccaagaccccaccccaactcacggttacccaaagtgggggtggagctcccagctctcagccccgcccattgaacgcaatcccagccgatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25994 - DNA, 4061 bp, Homo sapiens
aatattgcctgttctacagagttccctaattccatattgatgatacctattgggaaactttagtttttttaatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatactcagaaatgggatcatcgttcagtgtctctccaaaagcagaatctgccgtaatagtagcaaatcctagggaagaaataatcgtgaaaaataaagatgaagaagagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgagagcaacttggaaagtaaagtggataaaaaatgttttgcagatagccttgagcaaactaatcacgaaaaagatagtgagagtagtaatgatgatacttctttccccagtacgccagaaggtataaaggatcgttcaggagcatatatcacatgtgctccctttaacccagcagcaactgagagcattgcaacaaacatttttcctttgttaggagatcctacttcagaaaataagaccgatgaaaaaaaaatagaagaaaagaaggcccaaatagtaacagagaagaatactagcaccaaaacatcaaacccttttcttgtagcagcacaggattctgagacagattatgtcacaacagataatttaacaaaggtgactgaggaagtcgtggcaaacatgcctgaaggcctgactccagatttagtacaggaagcatgtgaaagtgaattgaatgaagttactggtacaaagattgcttatgaaacaaaaatggacttggttcaaacatcagaagttatgcaagagtcactctatcctgcagcacagctttgcccatcatttgaagagtcagaagctactccttcaccagttttgcctgacattgttatggaagcaccattgaattctgcagttcctagtgctggtgcttccgtgatacagcccagctcatcaccattagaagcttcttcagttaattatgaaagcataaaacatgagcctgaaaaccccccaccatatgaagaggccatgagtgtatcactaaaaaaagtatcaggaataaaggaagaaattaaagagcctgaaaatattaatgcagctcttcaagaaacagaagctccttatatatctattgcatgtgatttaattaaagaaacaaagctttctgctgaaccagctccggatttctctgattattcagaaatggcaaaagttgaacagccagtgcctgatcattctgagctagttgaagattcctcacctgattctgaaccagttgacttatttagtgatgattcaatacctgacgttccacaaaaacaagatgaaactgtgatgcttgtgaaagaaagtctcactgagacttcatttgagtcaatgatagaatatgaaaataaggaaaaactcagtgctttgccacctgagggaggaaagccatatttggaatcttttaagctcagtttagataacacaaaagataccctgttacctgatgaagtttcaacattgagcaaaaaggagaaaattcctttgcagatggaggagctcagtactgcagtttattcaaatgatgacttatttatttctaaggaagcacagataagagaaactgaaacgttttcagattcatctccaattgaaattatagatgagttccctacattgatcagttctaaaactgattcattttctaaattagccagggaatatactgacctagaagtatcccacaaaagtgaaattgctaatgccccggatggagctgggtcattgccttgcacagaattgccccatgacctttctttgaagaacatacaacccaaagttgaagagaaaatcagtttctcagatgacttttctaaaaatgggtctgctacatcaaaggtgctcttattgcctccagatgtttctgctttggccactcaagcagagatagagagcatagttaaacccaaagttcttgtgaaagaagctgagaaaaaacttccttccgatacagaaaaagaggacagatcaccatctgctatattttcagcagagctgagtaaaacttcagttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatctgaggagttggttcagaagtacagtaattctgctcttggtcatgtgaactgcacgataaaggaactcaggcgcctcttcttagttgatgatttagttgattctctgaagtttgcagtgttgatgtgggtatttacctatgttggtgccttgtttaatggtctgacactactgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctatctgaggcactggtggaataaaaaacctgtatattttactttgttgcagatagtcttgccgcatcttggcaagttgcagagatggtggagctagaaaaaaaaaaaaaaaagcccttttcagtttgtgcactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagacttaaaa

SEQ ID NO: 25995 - DNA, 589 bp, Homo sapiens
agggcctctgaggactgctgcagacacagctgaggcagcccggctccaggctcgctggaggggctgtgtctggggagatgcttctctataaaaagcttagagagagttgtcatcgaaaataacaagactattctggatatgagtaacactgaggaataagatactaagccattaaagaagggtataaaaattatgtctgacacaggatatggagagaaatatgatgaagatgaaatatgacaacagaatcaagatgagaccctttttgctcttcctgctgcatctgagcctgtgatacgctcctctgcagaaaatatggacttgaaggagcagccaggtaacactatttcggctggtcaagaggatttcccatctgtcctgcttgaaactgctgcttctcttccttctctgtctcctctctcagccgcttctttcaaagaacatgaataccttggtaatttgtcaacagtattacccactgaaggaacacttcaagaaaatgtcagtgaagcttctaaagaggtctcagagaaggcaaaaactctactcatagatagagatttaacagagttttcagaattagaatact

SEQ ID NO: 25996 - DNA, 1682 bp, Homo sapiens
ccggcggctaaggagagcgggcaggcaaggagattccgggccagggtcgcggcggcagtcggcaagcgttcgattctctggcgttggatcgcgagcggtgtctgcttgtcccgccgagggctcccaggacagggcagggatctagggggtttgcgcacctgctttttaatgccccgcccccccttttttttttaaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgtgttctaatcttaggcgcttcaggcggagttggtacttttgctatacaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgattgtt

SEQ ID NO: 25997 - DNA, 2266 bp, Homo sapiens
gcaaagccatcccggcggctaaggagagcgggcaggcaaggagattccgggccagggtcgcggcggcagtcggcaagcgttcgattctctggcgttggatcgcgagcggtgtctgcttgtcccgccgagggctcccaggacagggcagggatctagggggtttgcgcacctgctttttaatgccccgcccccccttttttttttaaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgattgttgacgttcttatttggtgagtgcctgtgagcccaaatttttttctagccatccctttcaaacatttttccagattagattatacattccatgatacaagctttaaaaaataaacacaccattttggccagtaattgatataaaaatatcagcacttggatttgtctgtagtcagtagaaattcgaagttttttcaagctgttccttcacactggctttgcaggttgttgtggcaccttctgttttactagcttaaactactttattgtcttttttgttttagagacagggtctcgctgtgtcacccaggctggagtgcagtggcacaatcacagctcactgcagccttgaccttaagcgattctcctgcttcagcctctcaagtaggtaggactacaggtatgcatcaccacacccagctagtttttttgtatttttagtagagacagttttgccatgttgcccaggctggtctcaaactcctgggcttaagtgatccaccatgtcagtctcccaaagttctgggattacaggcgtgaaccaccctgctgggcctgatcgtcttaatgtacaatactaaaactttcagtgtatagatggatgttggcatgaagagataatttaaagctggttccttcttgaattcatcactgagcagctttctaactgccaaggtttccttttttgttcctccaccataatgtggtcaccacagctcttaaagttctaaatctcttagtgtcatatataaaaatctgcctggtgattcatttgtttatgctcttaatattgaaaggtgagagcagagtttctaactttttaaaacccttacatcttgcataaggattaggcctgtttcggcaattgaaacatgcttctctgagggcttttccatggaaattgcagccttccaatggagcccaaagcttgccactttgatgtcaa

SEQ ID NO: 25998 - DNA, 2157 bp, Homo sapiens
ccgggccagcctaggccgccacaccctcgggcccgcgtccccggccggctccggcccgggccgccatcccctccgccgcctgcaggggccgccgcctcttcaggaatgcgccgcctttgtctgggaccgcgcggcgccggtgcaccgggcgggctgagcgcctcctgcggcccggcctgcgcgccccggcccgccgcgccgcccacgccccaacccccgcgccgccgccgccctcgccctgtgcgccctgcgcgccctgcgcacccgcggcccgagcccagccagagccgggcggagcggagcgcgccgagcctcgtcccgcggccgggccggggccgggccgtagcggcggcgcctggatgcggacccggccgcggggagacgggcgcccgccccgaaacgactttcagtccccgacgcgccccgcccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccagcggacacaagagcgtgctcagcagccaggtgtgtgtacatacggggtctctctccacgccgccaagccagccgggcggccgacccgtggggcaggccaggccaggtcctccctgatggacgcctgccgcccgccacccccatctccaccccatcatgtttacagggttcggcggcagcgtttgttccagaacgccgcctcccacccagatcgcggtatatagagatatgcattttattttacttgtgtaaaaatatcggacgacgtggaataaagagctcttttcttaa

SEQ ID NO: 25999 - DNA, 3197 bp, Homo sapiens
ctgggactaaggcggcagcgggctgagcgctcggccacccccagcgtgcgcagcccgggcgggcttcgcccgcggagcttgacctagggtcgggacccgtcgggttgcaccgccgcactcgggaagacccggcttcgagcctctcctctccgtctccaaagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgccccaaggcgcccgaggaaggctccgagccctccccgccgccagccccggcgcccgcccccgagtacgaagcccctcgaccctactgccccaaggagcccggggaggcacggccgagcccagggctgcccgtcgggccagccaccggcgaagcgaaactgtcagaggaggaacagcccaagaaaaagcatcggcggaaccgcacgactttcaccacgtaccagctgcatgagctggagcgcgcgttcgagaagtcccactacccggacgtgtacagccgcgaggagctggccggcaaggtcaacctaccagaggtccgggtccaggtgtggttccagaaccgacgggctaagtggcggcggcaggagaagctggaagtgtcctccatgaagctgcaggactcgcccctcctctccttcagccgctccccgccctccgcgacgctgtcgcccctcggggcgggcccgggcagcggtggcgggccggctgggggcgcgctgccgctggagtcctggctcgggccgccgctgccgggcgggggcgccacggcgctgcagagcctgccgggcttcgggccgccggcgcagagcctgcctgccagctacacgccaccgccgccgcctccgcccttcctgaactccccgccgttgggccccggcctgcaacctctcgcgccgccgccgccctcctacccgtgcgggcccggcttcggggacaagttcccgctggacgaggcggacccgcgcaacagcagcatcgcggcgctgcgtctgaaagccaaggagcacatccaggccatcgggaagccgtggcaggccctctaggggcactggggaacgtcttgggatccgaccccgggccgaccgcaccgtacccgcatcctctctcccagggacaacccccctccccagctcggcccctctttccctgtcgcctgcagccacccgccaagcatagttcagggccacgcgcctgctcccgatgcacggggagaagggcgactttcaggcctgaggagaggccctctggccgcctcaacgcacttcgcggacctcagccctgcagctggagggcaacaggctgccgggccccgctggccacgccgctcccatcaccgcaggcgctggagcctccaggcccaaacaggctgaagctcctaaacttggccattcccaggaggcttggagacccccagataaccataacagggaagcaggggaggcggaaaaatagagtttgagaaacttttgtataagtagtttcaaactatttgagaggagaattaaagacatgcttgttttgtttcgactctgtttaagcacgctcaggacttggggagaggagtgaatattggggtacgggaggagggtgcgttgacggacagggtgggtcagggaaagaggaggactgagaagaagctcagggtttccttgtgaaaattctagggacacttcgctgcagcagagaatcgtccccattccgaacgcttcggcggcctagaccagaggcgcccttccctggagccggcgtgcgcgcttggggtccggagtggatggggctaaggctcagatgctagcgcgctcccagttcccccgctagccccatagtccagcggcagctgatattttcaagtttgacttcaatagaaagcgtcaagaccaccttccctagggcgagagcgaagtgtcccccggcccctggcgtccccgctctcctaaggactcctctcagttcaccaagcagatctccggttcggtgccagtccctaacacccaaggttgatcaccagcggtacaagaactgaggcaaagagatgcttttccttttcggagccgcgagactctctaacctccccaactcgctccacactcgccaacccagagttcggtaaaaggcgcgtctggtgaggtgccgcgctcggagagtgtcctggagcgccctacgccaccgccccgagagctagttcttgcgggcgtgccctggacagtatctgcagttctttggcgccggctctagggcgaggaaggaatctcgaaatctcagcccgcttcacaatctcctgagactctctgaagaaggagagtcccggactcccgcctgagcgtgctcgatatccaccgttgacactggaagctgggcgaccgccagcagaacctggatgcccgccaacaggtcctggcacggggggggggggggcgtccaccccacaacccccgtccctaagcgtgctttcaggatgatgcccccagagccttaattagcatcaactggctactgtctgtcggtcctgagcaaattagtgaagctcccagtcccctttcctcgtctaaataaactctgtctctctggaaggtgggaaagatggaataagatcacctgtaaaggctttgtggaaagtaccaagaccctggcatgacgcaatatggattgtaatcatcgtccccatttccccgaaattccctggctgttctccggttcctgaaaccgacttgggaaaaggatgaccacgctggagctgggaatatgggaagcctcatcatagtttccagtcctttctctgcgggtctaagaggctattgcataaccagggctgtgtacccctagacctccagatggtgccttgcacacagtaggctgatcagtaaaaatgtactgaataaattattcccccccaagaggtagggagtaatatctgcacttttcctcacaaggatgtctccttgggggaggaggatggagcagcccgtgtgttatcaccttttagcaagaaaacaaaacaaaacaaaaccagaa

SEQ ID NO: 26000 - DNA, 473 bp, Homo sapiens
gccggcgctcaagtccgaggggactgggaggagttacaacagatatagacggacaaactaaacgcgaggtccgggacttcgtacaacccagccaagaaaggagtgggtcccgaaaagggagccagcgaggggaaattcaaactgcgacgagtgcggggctgggaagccttcggctgggtctcggcgcttccagggggcacaggccagggtggcggccccgcggagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgcccc

SEQ ID NO: 26001 - DNA, 4266 bp, Homo sapiens
ttcatgcccattacagtattcccatgcccctcacagggcagtgtgcatctgttttagtgctacctaatgtctgttaggtgcaagctggcccacacatggcttctaggcagaacagtctacaagtgacagcgtgaccagagagcagagacaggaaggaggcccagacatgagtgtgggatgctgcagaacagcaacaggatgcttctgctatccccaaatgttatctcaaatacctcaacgtcaatgctttctgttccatgttcctcttctccctggacagcccctccttctgaaagtcagaactgtctgctcttgagcttgccttgagggaaggaaataatttagataagcagagaggaagacaggcaagggatgtggtggggcaaaggcggagatgtatcttcacaggtccctgtcctcagcacccagaatcaccccttccctgtaggagggagctgatagaaagaggggatctccatccaggagccacccaccaggcagctggaaacatttgccaacagcaggtacacctagggctcagcagagggttgggtgagaatggtcttgcccagtttgtgccacactgagcaccggctggaggaggaagcggacagaatgccatctggacacaagtgctccctcactgcctgggcctgggtcgcctcaggcttttgtgtcagatcagccactccctctacagataatgctgctccaggcaaagaggcttaggtgggtctccagggcaaccgcagctcaggagctggcccgcctccatggttcatcagggaagctgtggctccagcctcgcgggatacatacacgcatacacacacacacacacacacacacacacacacacacacacacacctacacaccccacaaacaatagtccaggctggatctctcctcctgtctcttctcttggtaaaacttctcagagaaccaaagagaggcaaaatttgaggccagccggcagcagcagagaagctgagggagacttgaggatgtagactgccctgccctgctgtggctgctcaactttctttttttttcctgaaaatatccagacactctcttctcccagactgggaagcagaacgcaggccccctgctgtgacgctgcacctgagcagaggctgacctcagagcagggccaggggctatgtctctcatctcatggcttcggtggaacgaggccccatcccggctgtccaccaggagccctgctgagatggtgctggagacgcttatgatggagctgacggggcagatgcgagaggctgagaggcagcagcgggagcgcagcaatgcggtcagaaaggtctgcaccggtgtggactacagctggctggccagcacaccccggtccacctatgacctcagccccattgagcggttgcagctggaagatgtctgcgttaagatccacccatcctattgtgggcctgctatcctcaggttccggcagctgctggcggagcaggagcccgaggtgcaggaggtgtcccagctcttccgctcggtgctgcaggaggtcctggagaggatgaagcaggaagaggaggcccacaagctgacgcgccagtggagcctgcggccccgcggcagcctggccaccttcaagacccgcgcgcgcatctcgcccttcgccagcgacatcaggaccatctccgaggacgtggagcgggacacaccgccgccactgcggtcctggagcatgcccgaattccgggcgcccaaagccgactgaccccggccgcttccctgcccagaagcggagccttctgcagggggaatgataggccggtgaccggagcgccgggccctggaacctccccacctaggcctgacgaggagacccaagaggcggccccatcccaagacgctgctataaaatgaagcgactccctgccccatcctcttcctctggccacaaagctgagttaggtcgtagagcggcaccgccctctccctctcctgcgctagtctgcaggagcagccccttccctaactggcagattcaaggttttggaagacagaccattgccccatcctcatctcctggttctgtctaaaaggggacagttgccctgccttttggcaagacctaggttctcaccccaatttcagggatgtcccattcacccccctacccccatccccaatgagaagggacctgttggctggtatgccttcttgctagtgactggctgagctcaccactgcaggtgggtcacacacagcctcataggcaggcacagctggaagggaccagagagacatttagatccactctcttcagctagtaaatgtggaacttgaggctcagagagggacacttcttctgcctttaactgcagccagctcctcatgaacagtgagattgttcctgcatgaatagtgtctgttcctgagtttggaatcctgggctatgaagggacaggtccaaaggctacatctctacctacctgtggcctgatccatctcttaccttggcagtgggatgagaatctaagctgctctccaagaagtgtagctaggggtggaggtaggttactcattaccccacgccacaatgtcatcgcatgggctgtggccagtccctaacagcttcttccagaggctcagctccaaggacttcagatgctgccctaaagagcccaggtttctcaattccagggttccgctttctgcagctggtcacacctgctctctggctttctccagaaagtgatgcccaaacccctgactgaccttgaggcagctgagtgaaatgttctagaagagcttcctgcagcttcattgtccttcccttttctaacatggttaggccttgatgatgggcatgtggattacccaatgtgtggatcacccatggaaaatctggaaggccaggaggccttcccacacactctggggttgaagtggggtgtaagggggatgggtggggaagtgtctaccctcaactaccagcacacatgcagaaaatgcaagtggaccttaatagtagcctaaataaaatacccggaggagatataatcaacaggggggaaaagtgtgtattccctcagtggaaaaaagtttttttgaatgatttggttttgaacttcccttttgaagtttttttggattttcacttgaatctggacagagaatcataggatggtggaaaacctctgatccaacactatcaagatgaaagagttgattggcttattaatgtaattggtagaagttgagaatcacttaaaatatacatcttaaacatcttacgtattttatttgaagacataaaaagttcacttggttgccaaacttttttttttttttttgagactgagtctcactctgttacccaggctgcagtgcagtggcgtgatctcggctcaccacaacctttgcctcccgggttcaagtgattcttctgcctcagcctcctaagtagctgggactacaggcacgtgccatcaccccagctaatttttgtatttttattagagatggggtttcactatgttgcccagaatggtcttgaactcctgacctcgtgatccactcgccttggcctcccaaagtgctgggattacagacatgagccactgtgcctggctgccaaacttttgatgtgggtccaagctgtgcttttttgtgacctatatgttttgtctggtgggagttctacacttaagttttcttggtttgcactttaatcataacaataagaacaactggcgtaaaagagttttggaacaagcagaagtgacccttggtaagcagactgctcagctggtaggggcaaaagtgttgggggaggattagaaaaaggcctccacattgtgggctttccgggtgccctggatgtgggtcagcaaatgttttagaggaagtagttaacctggagggagattcaaaggaggctggataagagaatgtctatttttctccttccctatcaccttacatgtacctattctccccaaagagaaggaagaccttaggctttcaatgtggtgttctttcttaagtttaagtaactggctgccaatgaaaaccttcccttcgagccgcaggcatgtggacagaatccaccaccctccttagacactcctcagactactacaggctatccccagctggtggctctcaaattcatgagggtccagaagttgttcctctggattcaggttgttaaagggactaatgaggtctgcttccattactattattgaaacctcaataaccacaaataaaagaacaaaaagtt

SEQ ID NO: 26002 - DNA, 2094 bp, Homo sapiens
gggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcagtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatgttgctgcaaaagacatgatctcgttcttttttatggcagtgtagtattccattccatatacatatataaacgttatatatatgtaacgttttctttatccaatcatctgttgatggatagattccatatctttgctactgtaaacagctgtgataagcatacaagtgcaggtttctttttgatatactgatttcttttcctttgggtagataccagtagtaggactgctggatcaaatggtagctctatttttaagacagtatggagaaatcaccatactgttttccataggggttgtactaatttacagtcccaccaacagtgtataggtgttcccttttctctgcatccttaccaatatctgtaattttttgactttttaataatagccattctcacttgtgtgagataaggtctcattgtggttttaatttccatttctctgatgacttttgatgttaagcattttttcatatgcttcttagccacgtgtatgtattctttttgaaaaaatgtttattcatgtcttttgcccactttttaatggcattatttggattttttttgttgagttatttgagtttcttatatattctggataatagtctggataatatattctggataatatataatagtcttatatattctggatatattctggatacatggtttgcaaatattttctccggttctgcacgttgttcattctgttgatggtttattttgctgtgcagaaacttttttagtttaattaagtcccatttgtct

SEQ ID NO: 26003 - DNA, 2247 bp, Homo sapiens
agagacagctgggccactggcagtgagggagagtgaggatggcagagaccagtgccctgcccactggcttcggggagctcgaggtgctggctgtggggatggtgctactggtggaagctctctccggtctcagcctcaataccctgaccatcttctctttctgcaagaccccggagctgcggactccctgccacctactggtgctgagcttggctcttgcggacagtgggatcagcctgaatgccctcgttgcagccacatccagccttctccgtgtctcccacaggcgctggccctacggctcggacggctgccaggctcacggcttccagggctttgtgacagcgttggccagcatctgcagcagtgcagccatcgcatgggggcgttatcaccactactgcacccgtagccagctggcctggaactcagccgtctctctggtgctcttcgtgtggctgtcttctgccttctgggcagctctgccccttctgggttggggtcactacgactatgagccactggggacatgctgcaccctggactactccaagggggacagaaacttcaccagcttcctcttcaccatgtccttcttcaacttcgccatgcccctcttcatcacgatcacttcctacagtctcatggagcagaaactggggaagagtggccatctccaggtaaacaccactctgccagcaaggacgctgctgctcggctggggcccctatgccatcctgtatctatacgcagtcatcgcagacgtgacttccatctcccccaaactgcagatggtgcccgccctcattgccaaaatggtgcccacgatcaatgccatcaactatgccctgggcaatgagatggtctgcaggggaatctggcagtgcctctcaccgcagaagagggagaaggaccgaaccaagtgagcctgccaccctggagtgagccccaggccaggaggctgttccaggagtcctgcccagcagcctcagtggccaagcccagacactcacccaccttccccagtggccccgtggatcctggtcctaggctggacacaggattcagaaagacaccaggctgcacagaaagagccagatggacctgagtgtcggtcacagccccctacactcaaggctgagaggcctcaggaaagtcattcctttttaaaaataataataaatgtaagggggtacagtgcagttttgttacatggatagattgcctagtggtgaagtctgggcttttagtgtaaccatcaccctaataatatacgttgtacccattaagttatttctcatccctcaccccctcccaccttgtcacccttctgagtctccaatgtctattattccacactccatgtccacgtgtacacattatttagctcccacttacaagtgagaacatgtggtatttgactttctgtttttgagttatttcacttaaaataatgacctccagtttcatccatgttgctgcaaaagacatgatctcgttcttttttatggcagtgtagtattccattccatatacatatataaacgttatatatatgtaacgttttctttatccaatcatctgttgatggatagattccatatctttgctactgtaaacagctgtgataagcatacaagtgcaggtttctttttgatatactgatttcttttcctttgggtagataccagtagtaggactgctggatcaaatggtagctctatttttaagacagtatggagaaatcaccatactgttttccataggggttgtactaatttacagtcccaccaacagtgtataggtgttcccttttctctgcatccttaccaatatctgtaattttttgactttttaataatagccattctcacttgtgtgagataaggtctcattgtggttttaatttccatttctctgatgacttttgatgttaagcattttttcatatgcttcttagccacgtgtatgtattctttttgaaaaaatgtttattcatgtcttttgcccactttttaatggcattatttggattttttttgttgagttatttgagtttcttatatattctggataatagtctggataatatattctggataatatataatagtcttatatattctggatatattctggatacatggtttgcaaatattttctccggttctgcacgttgttcattctgttgatggtttattttgctgtgcagaaacttttttagtttaattaagtcccatttgtcta

SEQ ID NO: 26004 - DNA, 868 bp, Homo sapiens
tgaggatggcagagaccagtgccctgcccactggcttcggggagctcgaggtgctggctgtggggatggtgctactggtggaagaccccggagctgcggactccctgccacctactggtgctgagcttggctcttgcggacagtgggatcagcctgaatgccctcgttgcagccacatccagccttctccgtgtctcccacaggcgctggccctacggctcggacggctgccaggctcacggcttccagggctttgtgacagcgttggccagcatctgcagcagtgcagccatcgcatgggggcgttatcaccactactgcacccgccaaaatgctgccatcggtctcatcattttgagtggcgataggttagccctcttgtccacttggcctcagagcacttctcccactccttacatcccagcccctgcccctaatgctcccttggaccatcttatacacacacacacacacacacacacacacacacacacaccaccttctcagatagcaacaggcttctctgcctcaatatagaacagttaatccctgtgccagaggccttagatcaaagccctttctatactgagagcatggcagagcagtgtgaaggcaggcaaaggggaatgaggaggtctgaattcatctactccatccctgggtggttgtaggcatgtcaccttggccatctgtttctaaagctgaaagtctgaggcagcacaatggtccaggtagatattaattattgtgcccacagagaattgtttgaacctggaaggcagaggttgcagtgagctgagatggcaccactgcactccagcctgggcaacagaatgagactccgcctcaataaaaaaaaaaaaaaaaa

SEQ ID NO: 26005 - DNA, 1878 bp, Homo sapiens
acaaacaggcgccggacgcggagccgccaggaagcgcgggagggggggcgggcccgagggggggccgggccgcttggtaacccctccctgtccgggcctcgccgctcagtacgggggcggggctagccggctgaccccctggcctactcccggcctccggctccaggcccttcccggatccccgcccccggattcccaggggacggggaagggagcgcccgccccgatatctccgccccccagcccctaacccctcagggttgagcggaccaaccccaccacttccgcgaggggcaggggcggggtcacaaaacgggccctcggcctaggggcggagtttctcgtaaggggcaaggccaaggcatcttgtattggggctgacaggggggcgggttattagggctgaggatgggaggatgctcagggtattggggtcagggtggcattagcccagctcaagccgggccgggctgactcagcatcctgccccagccagcttccatccctgacacctctgcattcccttgggcagagatgggagatggcgccggtgttgcccctggtgctgcccctgcagccccgcatccgcctggcacaagggctctggctcctctcctggctgctggcgctggctggtggcgtcatcctcctctgtagtgggcacctcctggtccagctaaggcaccttggcaccttcctggctccctcctgtcagttccctgtcctgccccaggctgccctggcagcgggcgcggtggctctgggcacaggactagtgggtgtaggagccagccgggcaagtctgaatgcagctctataccctccctggcgaggggtcctgggcccgctgctggtggctggcacggctggtgggggggggctcctggtcgtcggcctcgggctagccctggctttgcctgggagtctggatgaggcgctggaggagggcctggtgactgccttggctcactacaaggacacagaggtgcctgggcactgtcaggccaaaaggctggtggatgagctgcaactgaggtaccactgctgcgggcgccacgggtacaaggattggtttggggtccagtgggtcagcagccgttacctggatcccggtgaccgggatgtggctgaccggatccagagcaatgtagaaggcctatacctgactgatggggtccctttctcctgttgcaacccccactcaccccggccttgcctgcaaaaccgtctttcagactcctacgcccaccccctgttcgatccccgacaacccaaccaaaacctctgggcccaagggtgccatgaggtgctgctggagcacttgcaggacttggcaggcacactgggtagcatgctggctgtcaccttcctactgcaggctctggtgctccttggcctgcggtacctgcaaacagcactggaggggcttggaggggtcattgatgcgggaggagagacccagggctatctctttcccagtgggctgaaagatatgctgaaaacagcatggctacagggaggggttgcctgcaggccagcacctgaggaggccccaccaggagaagcacctcccaaggaggatctatctgaggcctagaggcctggagcttggggtgaggaagagggagggatggacaagtctgaaaacctcacaactccttaccaaggctccaggttggggggatcgtaggattagaggggctaaggatagtcagcgagctggactggggtaagaaagaaaaccagatgtcctagggcctagcccttgtagtcagaaccaccagggaacagcaaagaacagagtgatgggaaagtgacatgagaaggcctggaggctgattctgatatagactcaataaagtttttggatggaagcaa

SEQ ID NO: 26006 - DNA, 2610 bp, Homo sapiens
tccttcttcattctgcagttggtgccagaactctggatcctgaactggaagaaaatgtctatccaggttgagcatcctgctggtggttacaagaaactgtttgaaactgtggaggaactgtcctcgccgctcacagctcatgtaacaggcaggatccccctctggctcaccggcagtctccttcgatgtgggccaggactctttgaagttggatctgagccattttaccacctgtttgatgggcaagccctcctgcacaagtttgactttaaagaaggacatgtcacataccacagaaggttcatccgcactgatgcttacgtacgggcaatgactgagaaaaggatcgtcataacagaatttggcacctgtgctttcccagatccctgcaagaatatattttccaggtttttttcttactttcgaggagtagaggttactgacaatgcccttgttaatgtctacccagtgggggaagattactacgcttgcacagagaccaactttattacaaagattaatccagagaccttggagacaattaagcaggttgatctttgcaactatgtctctgtcaatggggccactgctcacccccacattgaaaatgatggaaccgtttacaatattggtaattgctttggaaaaaatttttcaattgcctacaacattgtaaagatcccaccactgcaagcagacaaggaagatccaataagcaagtcagagatcgttgtacaattcccctgcagtgaccgattcaagccatcttacgttcatagttttggtctgactcccaactatatcgtttttgtggagacaccagtcaaaattaacctgttcaagttcctttcttcatggagtctttggggagccaactacatggattgttttgagtccaatgaaaccatgggggtttggcttcatattgctgacaaaaaaaggaaaaagtacctcaataataaatacagaacttctcctttcaacctcttccatcacatcaacacctatgaagacaatgggtttctgattgtggatctctgctgctggaaaggatttgagtttgtttataattacttatatttagccaatttacgtgagaactgggaagaggtgaaaaaaaatgccagaaaggctccccaacctgaagttaggagatatgtacttcctttgaatattgacaaggctgacacaggcaagaatttagtcacgctccccaatacaactgccactgcaattctgtgcagtgacgagactatctggctggagcctgaagttctcttttcagggcctcgtcaagcatttgagtttcctcaaatcaattaccagaagtattgtgggaaaccttacacatatgcgtatggacttggcttgaatcactttgttccagataggctctgtaagctgaatgtcaaaactaaagaaacttgggtttggcaagagcctgattcatacccatcagaacccatctttgtttctcacccagatgccttggaagaagatgatggtgtagttctgagtgtggtggtgagcccaggagcaggacaaaagcctgcttatctcctgattctgaatgccaaggacttaagtgaagttgcccgggctgaagtggagattaacatccctgtcacctttcatggactgttcaaaaaatcttgagcatactccagcaagatatgtttttggtagcaaaactgagaaaatcagcttcaggtctgcaatcaaattctgttcaattttagcctgctatatgtcatggttttaacttgcagatgcgcacaattttgcaatgttttacagaaagcactgagttgagcaagcaattcctttatttaaaaaaaaaagtacgtatttagataatcatacttcctctgtgagacaggccataactgaaaaactcttaaatatttagcaatcaaataggaaatgaatgtggacttactaaatggcttttaattcctattataagagcatattttaggtacctatctgctccaattatatttttaacatttaaaaaccaaagtcctctacacttgatttatattatatgtggctttgctgagtcaaggaagtatcatgcaataaggcttaattactaaatgtcaaaccaaactttttctcaaaccagggactatcatctaagattaattacagtaattattttgcgtatacgtaactgctcaaagattatgaatcttatgaatgttaacctttccgtttattacaagcaagtactattatttctgattttataataagaaaatctgtgtttaatcaactgaggcctctcaaccaaataacatctcagagattaagttatatattaaaagcttatgtaacataaaagcaagtacatatagtagtgactatatttaaaaaaacagcataaaatgcttaaaaatgtaatatttactaaaatcagattatgggataatgttgcaggattatactttattgcatcttttttgtttaattgtatttaagcattgtgcaatcacttgggaaaaatattaaattattaacattgaggtattaatacattttaagccttttgtttttaaatttcttttcttccagagattgtttaaaaataaatattgacaaaaataa

SEQ ID NO: 26007 - DNA, 1752 bp, Homo sapiens
gagcccgatttaacggaaactgtgggcggtgagaagttccttatgacacactaatcccaacctgctgaccggaccacgcctccagcggagggaacctctagagctccaggacattcaggtaccaggtagccccaaggaggagctgccgacctggcagggaacaaccaagactggggttaaatctcacagcctgcaagtggaagagaagaacttgaacccaggtccaacttttgcgccacagcaggctgcctcttggtcctgacaggaagtcacaacttggccctgacttcctatcctagggaaggggccggctggagaggccaggacagagaaagcagatcccttctttttccaaggactctgtgtcttccataggcaacatgtcagaaggggtgggcacgttccgcatggtacctgaagaggaacaggagctccgtgcccaactggagcagctcacaaccaaggaccatggacctgtctttggcccgtgcagccagctgccccgccacaccttgcagaaggccaaggatgagctgaacgagagagaggagacccgggaggaggcagtgcgagagctgcaggagatggtgcaggcgcaggcggcctcgggggaggagctggcggtggccgtggcggagagggtgcaagagaaggacagcggcttcttcctgcgcttcatccgcgcacggaagttcaacgtgggccgtgcctatgagctgctcagaggctatgtgaatttccggctgcagtaccctgagctctttgacagcctgtccccagaggctgtccgctgcaccattgaagctggctaccctggtgtcctctctagtcgggacaagtatggccgagtggtcatgctcttcaacattgagaactggcaaagtcaagaaatcacctttgatgagatcttgcaggcatattgcttcatcctggagaagctgctggagaatgaggaaactcaaatcaatggcttctgcatcattgagaacttcaagggctttaccatgcagcaggctgctagtctccggacttcagatctcaggaagatggtggacatgctccaggattccttcccagcccggttcaaagccatccacttcatccaccagccatggtacttcaccacgacctacaatgtggtcaagcccttcttgaagagcaagctgcttgagagggtctttgtccacggggatgacctttctggtttctaccaggagatcgatgagaacatcctgccctctgacttcgggggcacgctgcccaagtatgatggcaaggccgttgctgagcagctctttggcccccaggcccaagctgagaacacagccttctgaaaacatctcctgccagctgaactgtagttagaatctctgggcctctcctcaactgtcctggacccaaggctaggaaagggctgcttgagatgactgtggtccccccttagactccctaagcccgagtgagctcaggtgtcaccctgttctcaagttgggggatgggtaataaaggagggggaattcccttgaacaagaagaactggggatagttatatttccacctgcccttgaagctttaagacagtgatttttgtgtaaggttgtatttcaaagactcgaattcattttctcagtcatttcctttgtaacagagttttacgacttagagtctgtgaaaacaggcaaggagcccgggttaaaatatccccctattcgcccccaaaatgcaataaaagaagataaaagagagaggata

SEQ ID NO: 26008 - DNA, 7100 bp, Homo sapiens
gacatactgagaataaatccaaagacattagtttctttgcacgaaatgaggttacatatccagtgacatttatttgagctatttaaacaacttaaacatctttttcttttcttaataagggacgtttcaagttgtggtctcagccaaaatgagtgataccccttctactggtttttccatcattcatcctacgtcttctgaaggtcaagttccaccccctcgccatttgagcctcactcatcctgttgtggccaagcgaatcagtttctacaagagcggagacccccaattcggcggggtcagggtggtggtcaaccctcgctcctttaagtcctttgatgctctgctggataacttgtccaggaaggtgcccctcccttttggagtgaggaacatcagcacccctcggggcaggcacagcatcacgcgcctggaggagctggaggacggcgagtcctacctatgttcccacggcaggaaggtgcagcctgtagacctggacaaagcccgtcggcgcccgcggccctggctcagcagccgggccattagcgcgcactcaccgccccaccccgtagccgtcgctgctcccggcatgccccgccccccacggagcctagtggtcttcaggaatggcgacccgaagacgaggcgtgcggttcttctgagcaggagggtcacccagagcttcgaggcatttctacagcacctgacagaggtcatgcagcgccctgtggtcaagctgtacgctacggacggaaggagggttcccagcctccaggcagtgatcctgagctctggagctgtggtggcggcaggaagggagccatttaaaccaggaaattatgacatccaaaaatacttgcttcctgctagattaccagggatctctcagcgtgtgtaccccaagggaaatgcaaagtcagaaagcagaaagataagcacacatatgtcttcaagctcaaggtcccagatttattctgtttcttctgagaaaacacataataatgattgctacttagactattcttttgttcctgaaaagtacttggccttagaaaagaatgattctcagaatttaccaatatatccttctgaagatgatattgagaaatcaattatttttaatcaagacggcactatgacagttgagatgaaagttcgattcagaataaaagaggaagaaaccataaaatggacaactactgtcagtaaaactggtccttctaataatgatgaaaagagtgagatgagttttccaggaagaacagaaagtcgatcatctggtttaaagcttgcagcatgttcattctctgcagatgtgtcacctatggagcgaagcagtaatcaagagggcagtttggcagaggagataaacattcaaatgacagatcaagtggctgaaacttgcagttctgctagttgggagaatgctactgtggacacagatatcatccagggaactcaagaccaagcaaagcatcgtttttataggccccctacacctggactaagaagagtgagacaaaagaaatctgtgattggcagtgtgaccttagtatctgaaactgaggttcaagagaaaatgattggacagttttcatatagtgaagaaagggaaagtggggaaaacaagtctgagtatcacatgtttacacattcttgcagtaaaatgtcatcagtatctaacaaaccagtacttgttcagatcaataacaatgatcaaatggaggagtcatcattagaaagaaaaaaggaaaacagtctgcttaagtcaagtgcaataagtgctggtgttatagaaattacaagtcagaagatgttagagatgtcacataataatggtttgccatcaactatatcaaataactcaattgtggaggaagatgtagttgattgtgtggtattggacaacaaaactggtatcaagaacttcaaaacttatggtaacaccaatgataggttcagtcctatttcagcagatgcaacccatttttcaagtaataactctggaactgacaaaaatatttctgaggctccagcttcagaagcatcctctactgtcactgcaagaattgacagactaattaatgaatttgctcagtgtggtttaacaaaacttccaaaaaatgaaaagaagattttgtcatctgttgccagcaaaaagaagaaaaaatctcgacagcaagcaataaattccaggtatcaagatggacagcttgcaaccaaaggaattcttaataagaatgagagaataaacacaaaaggtagaattacaaaggaaatgatagtgcaagattcagatagtccccttaaaggagggatactttgtgaggaagacctccagaaaagtgatactgtaattgaatcaaatactttttgttccaaaagtaatctcaattccacgatttccaagaatttccatagaaataaattaaatactactcaaaattccaaggttcaaggacttttaaccaaaagaaaatctagatcactaaataaaataagcttaggagcacctaaaaaaagagaaatcggtcaaagagataaagtgtttcctcacaatgaatctaaatattgcaaaagtacttttgaaaacaaaagtttatttcatgtatttaacatccttgagcaaaaacccaaagatttttatgcaccgcaatctcaagcagaagtggcatctgggtatttgagaggaatggcaaagaagagtttagtttcaaaagttactgattcacacataactttaaaaagccagaaaaaacgtaaaggggataaagtgaaagcaagtgctattttaagtaaacaacatgctacaaccagggcaaattctttagcttctttgaaaaaacctgattttcctgaggctattgctcatcattcaattcaaaattatatacagagttggttgcagaacataaatccatatccaactttaaagcctataaaatcagctccagtatgtagaaatgaaacgagtgtggtaaattgtagcaataatagtttttcagggaatgatccccatacaaattctggaaaaataagtaattttgttatggaaagtaataagcacataactaaaattgccggtttgacaggagataatctatgtaaagagggagataagtcttttattgccaatgacactggtgaagaagatctccatgagacacaggttggatctctgaatgatgcttatttggttcccctgcatgaacactgtactttgtcacagtcagctattaatgatcataatactaaaagtcatatagctgctgaaaaatcaggaccagagaaaaaacttgtttaccaggaaataaacctagctagaaaaaggcaaagtgtagaggctgccattcaagtagatcctatagaagaggaaactccaaaagacctcttaccagtcctgatgcttcaccaattgcaagcttcagttcctggtattcacaagactcagaatggagttgttcaaatgccaggttcacttgcaggtgttccctttcattctgcaatatgtaattcatccactaatctccttctagcttggctcttggtgctaaacctaaagggaagtatgaatagcttctgtcaagttgatgctcacaaggctaccaacaaatcttcagaaacacttgcattgttggagattctaaagcacatagctatcacagaggaagctgatgacttgaaagctgctgttgccaatttagtggagtcaactacaagccactttggactcagtgagaaagaacaagacatggttccaatagatctttctgcaaattgttccacggtcaacattcagagtgttcctaagtgcagtgaaaatgaaagaacacaaggaatctcctctttggatggaggttgctctgccagtgaggcatgtgcccctgaagtctgtgttttggaagtgacttgctctccatgtgagatgtgcactgtaaataaggcttattctccaaaagagacatgtaaccccagtgacactttttttcctagtgatggttatggtgtggatcagacttctatgaataaggcttgtttcctaggagaggtctgttcacttactgatactgtgttttctgataaggcttgtgctcaaaaggagaaccatacctatgagggagcttgcccaattgatgagacctacgttcctgtcaatgtctgcaataccattgactttttaaactccaaagaaaacacatatactgataacttggattcaactgaagagttagaaagaggtgatgacattcagaaagatctaaatattttgacagaccctgaatataaaaatggatttaatacattggtgtcacatcaaaatgtcagtaatttaagctcctgtggcctttgcctaagtgaaaaagaagcagaacttgataagaaacatagttctctagatgattttgaaaattgttcactaaggaagtttcaggatgaaaatgcatatacttcctttgatatggaagaaccacggacttctgaagaaccaggctcaataaccaacagcatgacatcaagtgaaagaaacatttcagaattggaatcttttgaagaattagaaaaccatgacactgatatctttaatacagtggtaaatggaggagagcaagccactgaagaattaatccaagaagaggtagaggctagtaaaactttagaattgatagacatctctagtaagaatattatggaagaaaaaagaatgaacggtataatttatgaaataatcagtaagaggctggcaacaccaccatctttagatttttgctatgattctaagcaaaatagtgaaaaggagaccaatgaaggagaaactaagatggtaaaaatgatggtgaaaactatggaaactggaagttattcagagtcctctcctgatttaaaaaaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactctcctcttcagaactcgaggaactgactcaaccccttgaactaaaatgcaattactttaacatgcctcatggtagtgactcagaaccttttcatgaggacttgctggatgttcgcaatgaaacctgtgccaaggaaagaatagcaaatcatcatacagaggagaagggtagtcatcagtcagaaagagtatgcacatctgtcactcattcctttatttctgctggtaacaaagtctaccctgtctctgatgatgctattaaaaaccaaccattgcctggcagtaatatgattcatggtacacttcaggaagctgactctttggataaactgtatgctctttgtggtcaacattgcccaatactaactgttattatccaacccatgaatgaggaagaccgaggatttgcatatcgcaaagaatctgatattgaaaatttcttgggtttttatttatggatgaaaatacacccatatttacttcagacagacaaaaatgtgttcagggaagagaacaataaagcaagtatgagacaaaatcttattgataatgccattggtgatatatttgatcagttttatttcagtaacacatttgacttgatgggtaaaagaagaaaacaaaaaagaattaacttcttggggttagaggaagaaggtaatttaaagaaatttcaaccagatttgaaggaaaggttttgtatgaatttcttgcacacatcattgttagttgtgggtaatgtggattcaaatacacaagacctcagcggtcagacaaatgaaatctttaaagcagtcgatgagaataacaacttattaaataacagattccagggctcaagaacaaatctcaaccaagtagtaagagaaaatatcaactgtcattacttctttgaaatgcttggtcaagcttgcctcttagatatttgccaagttgagacctccttaaatattagcaacagaaatattttagaactttgtatgtttgagggtgaaaatcttttcatttgggaagaggaagacatattaaatttaactgatcttgaaagcagtagagaacaagaagatttataatttcaatatcagcacactcattctttgtcaattcattttttcccatgagatgaagcacatgtgacgaatacggactagataacctctaagaattttccacttcttcaaaatgaacttactctagaaagcttacccttggataaccagtttgactttcataatgtctctgttttttgtttttccaacaattacagactcaggttctcttattttggaagtttctatctggttttgttctgaacttacattttttttttttttggtatctatgattttttttgctcagggcatcaaaatgtgctaaggacaagaattatatcctttttaaaaaatgttgttagcttggtgtaaaatgtatattgactgtattggtgaataaattgaatagacataacctcaaagtacttcacttattctttttaactactgatttgataaaaagtatgattataagatatccacgacaatctcatagtttctt

SEQ ID NO: 26009 - DNA, 3606 bp, Homo sapiens
aattagaggagggttcactcgtaggcagcatctgagcaacaggctcaccagacttcagcctcttcactccgactcttccacgctccagctctcttcattaagatattctagaagcaactgaggagtttctacaaacattttggaaattacaggtctcagccaaaatgagtgataccccttctactggtttttccatcattcatcctacgtcttctgaaggtcaagttccaccccctcgccatttgagcctcactcatcctgttgtggccaagcgaatcagtttctacaagagcggagacccccaattcggcggggtcagggtggtggtcaaccctcgctcctttaagtcctttgatgctctgctggataacttgtccaggaaggtgcccctcccttttggagtgaggaacatcagcacccctcggggcaggcacagcatcacgcgcctggaggagctggaggacggcgagtcctacctatgttcccacggcaggaaggtgcagcctgtagacctggacaaagcccgtcggcgcccgcggccctggctcagcagccgggccattagcgcgcactcaccgccccaccccggagcctagtggtcttcaggaatggcgacccgaagacgaggcgtgcggttcttctgagcaggagggtcacccagagcttcgaggcatttctacagcacctgacagaggtcatgcagcgccctgtggtcaagctgtacgctacggacggaaggagggttcccagcctccaggcagtgatcctgagctctggagctgtggtggcggcaggaagggagccatttaaaccaggaaattatgacatccaaaaatacttgcttcctgctagattaccagggatctctcagcgtgtgtaccccaagggaaatgcaaagtcagaaagcagaaagagtagtaactggaaagtttttataatcaccagtgacttgccagatgcagggaccagctcacagatttatattattctgtatggacaacatagaagttcagcccccatatatctttatggaacagatggggctcgatttcaggttggccatgaagacatatttactataacagttggagacattggagcactctttaagattcgtattggtcataccaactctggatcctccccttcctggcactgcaaggagatacagctgcataatatgaattctggaaaacagttttatgtacctgttcaacgatggttggcacgagatcaagaggatggggaaatctgtcgagaatttcctcttttaagtaaaggacaacctgtccttccagtgacaatatatgaagtgaatgtggcaacgggtgagctatggaatgctggaacagtagcaaacgtctacatttctatccatggggaaaagggagatacaggatccagacaactatttagatcgaagagctccttcaattttttaagaggacaaactgacacctttttcctggaggctgtgcaccttggagatttgtgtaagattgtgataggccatgatggacttggcccaggaaatggttggtttcttgatgatgttgttatcaaggatcccacaacaaattacgaatatgccttcttctgtcacagatggctagatcagggggaagatgattgtaaaattgtcagagaactgtatgccagggataacagtatcttctctgcgaggcagaaattggaacttaagagaaaagaaacatggactgcagaaagctggaagtttacaaaaggaaatactcttcagttctataacaagctgactggagggtttgtccgtttgcatccagatggcacagttgacgccattggagagaagacagacaaatatggtgtctttgatgttattttcaacaaaagaaatatatgcattttccaaagtcatgagatgaggcatctttctcttgctcttgacaatggcattgtcactggaatggttagtggtgaagccaccactgagctgcgggtgctttatcagcctaaccgctgtgcacttcttgagtcggcactggttcctggtcacacagttgtttttgatcgtcatggcaaaatagctgatgcatcatcagcaggctatgcaaatctttcaaaagaatttgtgatttttgtcaagggggtgttcctcaacagtgctgtggttctgcttgctacaagcctgtgtcaggccctgtgtctccagcctgatggaagctgcactggagtgggaagccagtctgaaaaatcctactggaaagtgcataaaatcagctctgggatttgcatgtttgaaagtgtgaaaaatgcacaaatgtatctaagaatcaaggatggccgatgcgatggaacaggtacaggagatgttgactgtcattttaaaattaagaagaacttgaagaatgcatccataagcctggaatctacgaagagcccaggattgtttgttggacttcagtcagatgggcaggcaaaaccaatgatttataccaaggatgagaatgtttgcttctatccacaagtcatccaatttggcagagaaaacccaatgggaatgtctgcaacacccagccaagaagaagaaaagatccatgagtcaaaaaaacagaaaaaaatacccccagaatctgaggctaggagtcccttaccttcttcaactgcaaaagaaatcagacatttccaaagtagtgagactcttctgtcagaagatgaatggaaggtgttagtgctgacaggaaatacaggaactcaagccaatgtcactctctgggtgtatggagataaaggagtcactgggccaataagtcttcgcaaggacagctcagagcagctcttccttccaggacacgaggatgagtttcaggttgaaataagaaacactggaaacatatataagataaggataggacatgatggaaccagtgagcaacccgagtggaacttgcagagggtgaccatgcaacatatgaaaagcaagaagatcctagattttgcagcaaacgtatggctgtctcggattcaggcagatggggatgttgtctgtgagcttcctgtagtaaaaggaggacaagctatttttccattagtgagataccaggttgacgtctacactgggcagctgaagcatgcagagacggagtctgaggttttcctctgtctctttggggagaggggagactctggcctcagacagctgtacaaatctaacatgcaagtaaaatttcaaagaggacagattgataaatttcaagtagcagcagtgtcgcttggaaaactgcagaaggtgctgttgcgctgtgaggccagtgacaaatcacagtactggtactgtgaacaagtcatagtcagagagcccggcaccacatccgagtccatctttacctgtcaaagatggcttcctttcatgtctcagggcataattcattcagaaattgaactttatcttcaaggtgaggattactgaaaccatcagtagaagaaagtacaagatgattttgttacatctggacatcatggaacactattccccagttttcctcagaacatcccctttgatatttatcttttattattggatttatagtattcctcacagtgaaataaaaacatatgtaaagctgt

SEQ ID NO: 26010 - DNA, 7973 bp, Homo sapiens
gcccaagggactggggcctcaggctctcaggccaaggagagtggccccgaggactgtccggaggagggtggccagccctgctgcccagagggactgagccactggcagggaaggaggcggtgttccccctggcctgactttcctccaaaggacgtccccctgaggcttaggggctgagccatgcccttgtgctccctggaggacgcggccagagcccccacaccatgaacagcacccccaggaatgcccaggccccgagccaccgtgagtgcttcctgccctctgtggctcgcaccccctcggtcaccaaggtcacgccagccaagaagatcaccttcctcaagcgaggggatccacggtttgctggggtccgcctggccgttcaccagcgcgcctttaagaccttcagcgccctcatggacgagctctcccagcgcgtgcctctctcctttggggtgcgctctgtcaccacaccccggggcctgcatagcctcagcgccctggagcagctggaagatggaggctgctacctctgctctgataagaagccccccaagacccccagtggaccaggccggccacaggagagaaaccccactgctcagcagttgcgggatgtcgaaggccagcgtgaagccccaggcacctcctcctcccggaagagtcttaaaaccccccggaggatactgctgattaagaacatggaccctcgcctccagcagacagtggttctcagtcacaggaatactaggaacctggccgcctttctcggcaaagcctcagatctcctgcgctttcctgtgaagcagttgtacacgaccagcgggaaaaaggtggactcgctgcaggccctgctgcacagcccctctgtgctggtgtgtgccgggcatgaggccttcagaaccccagccatgaaaaatgccaggagaagcgaggctgaaactttatctgggctgacttcaagaaacaaaaacgggagctgggggccaaagaccaagccgagtgtgatccattcgcggtctccgccaggcagcacgccacggctgccagaaaggcctggtcctagcaaccccccggtgggccctgctcctggcaggcaccctcaggacacgccagctcagtcgggcccgctggtggctggcgatgacatgaagaagaaggtccgcatgaatgaggacggcagcctgtccgtggagatgaaagtccgcttccacctggtcggcgaggacacgctcctatggtcccggaggatgggcagggccagcgccctcacggcagccagtggggaagaccccgttctgggggaggtagaccccctctgctgtgtgtgggagggctacccttggggcttctcagagcctggggtgtggggaccccggccctgcagggtgggatgcagggaagtctttggccgaggcgggcagccagggcccaagtatgaaatctggacgaatcccctgcatgcctcccagggagagagagtggcagctcggaagaggtggggactggcccagcacgtccgctgcagtggcctgtggggccacgggactgccgggagggagagatgcagccaggacagtgccagcccagcctccagcaccggcctccccgagggctcggagccagagtcctcctgctgccccaggaccccggaggacggggtggacagtgccagcccctctgcccagataggggctgagcggaaagctggagggagcctgggtgaggaccccggcctatgcatagatggagcagggctgggcggcccagagcaaggcggccgcctgacaccgagggcccggagtgaggagggggcttcttcggactcgtcagccagcaccggctctcatgagggatccagcgaatggggtgggcggccccagggctgtccaggcaaggcaagggccgagacctctcagcaggaggccagcgagggaggcgaccccgcttctccagccctgagtctttcatctttaaggagtgacgacctgcaggcagagacgcaaggacagggcaccgagcaggccacgggagcggctgtgacaagggagcctctggttctgggcctttcctgctcctgggactcggaaggagcctcttccaccccttccacctgcacttcatcccagcaggggcagagaaggcacagaagccgggccagtgcaatgtcctcacccagcagccctggccttggccgagtggccccgagaggccatcccaggcattctcactaccgcaaggacacccacagcccactggactcctctgtaaccaagcaagtgccgaggcctcctgagcggcgaagggcctgccaggatggctcagtgccacgatattctggaagctcatcgagcaccaggacacaggcctctgggaacctgagacctccctcctcgggctctcttccttcccaggaccttctgggaaccagcagtgccactgtcacccctgcagtccactcggattttgtttctggagtctccccgcacaacgctccctctgccgggtgggcaggggacgcggggtccaggacatgctcgccggcccccatacctccccacacatccgactcctgctcaaaatctggggctgccagcctgggggaagaggccagggacacgcctcagccctcctcacccttggttctgcaggttggacggcctgagcaaggggcggtgggcccccaccgaagccactgctgctcacagcctgggacgcagccggcccaagaggcccagcggggaccctcccctgaggctagctggctgtgtggcaggtactgtcccaccccgcccagggggcggccctgcccccagaggcgctcttccagctgtgggagcaccggcagcagccaccaaagcactgcccgggggccaggtgggagcccgcaggaggggacacgccagccaggccccacgccgtccccaggccccaattcaggggcatcaaggagaagcagtgccagccagggtgcggggtctcgggggctgtccgaggagaagaccttgaggagtgggggaggcccccaggggcaggaggaggccagtggtgtgtcacccagctctctgccccgctcgtctccagaggctgtggtccgcgaatggctggacaacattccagaagagcccatactcatgacatatgagttggcggacgagaccacaggtgcagctgggggtggcctgagaggccccgaggtggaccctggggatgaccattctctggaaggcctgggggagccagctcaggcgggacagcagtccctggaaggggaccccggccaggacccagagccagagggagccctcctggggagtagtgacactggtccccaatcaggagagggtgtcccccaaggggcagctccagagggagtttccgaggcccctgcagaggccggagcagacagagaggccccagcaggctgcagggtgagcctgcgggcacttcctggccgggtgtctgcctccacgcagatcatgagggcgctgatgggctccaagcagggccggcccagcagcgtgcccgaagtgtctaggcccatggccaggaggctcagctgctcagccggggccctcattacttgtctggccagtctgcagttatttgaggaagaccttgggtctcctgccagcaaagtgaggttcaaagactcccctcggtaccaggagctgctcagcatctcgaaggacctgtggccaggatgtgacgttggggaagaccagctggactcaggcctctgggagctcacatggagccaggctctgccagaccttgggtcccatgccatgacggagaacttcacgcccacatcctcctctggtgtggacatcagcagcggctctggaggctcaggggagagtagcgtaccctgtgccatggacggcaccctggtgacacaggggacagagctgcccctgaaaacctccaaccagaggcctgattcaagaacttatgagagcccaggggatctggaaaaccaacagcagtgttgtttcccaaccttcttgaacgcccgagcctgcgcttgtgccaccaatgaggatgaagcagaaagagacagtgaggagcagagggcgagctcgaacctggagcagttagctgaaaacacagtgcaagaagaggtgcaattagaggaaactaaagaaggaacagaaggagaagggctgcaagaagaggcggtgcagttagaggaaactaaaacagaagaagggctgcaagaagagggggtgcagttagaggaaactaaagaaacagaaggagaaggacagcaagaagaagaggcgcagttagaggaaattgaagaaacaggaggagaagggctgcaagaagagggggtgcagttagaggaagttaaagaagggccagaaggaggactgcaaggagaggctcttgaagagggtctcaaagaggaaggacttccagaagaaggaagcgtccacgggcaggaattgtcagaggccagctctccggatgggaaaggctcccaggaagatgacccagtccaggaggaggaagcaggaagagcctctgcctctgcagagccgtgccccgcagagggcacagaggaacccacagagccccctagtcatctcagcgagacggacccaagtgccagcgagaggcagagtggctcccagcttgagcctggtttggaaaagccgcccggagccaccatgatgggccaagagcacacgcaggcccaacccacccagggggctgcagagaggagctcttcggtggcctgcagcgcggctctggactgcgaccccatctgggtgtccgtgttactgaagaagacggagaaggccttcctggcccaccttgccagtgcggtggctgagctccgagcacgctggggcctgcaggacaatgatctgctggaccagatggcggccgagctgcagcaggacgtggcccaacgcctccaggacagcaccaagagagagctccagaagctccagggccgggcgggtaggatggtgctggagcctccaagggaggccctcaccggggagctgctcctgcagacccagcagcgcagacaccgtctccggggcctgcgaaacctctcggccttctctgagcggaccctgggcctggggcccctctccttcaccctggaggacgagccagccctcagcacagccctggggagccagctgggcgaggaggcggagggggaggagttctgtccctgcgaggcctgcgtgaggaagaaagtgagccctatgtcccccaaggccacaatgggggcaaccagaggtcccatcaaagaggcctttgacctgcagcagattctgcagaggaagaggggagaacacactgatggggaggcagcagaggtggcccctggcaagacccacacggaccccacgagcactaggactgtccagggagctgagggagggctggggccggggctgagccaggggcctggagtggacgagggtgaggatggcgaggggagccagagactcaacagagacaaagatcccaaactcggggaggcagagggagatgcaatggctcaggagagagaagggaaaacccacaacagtgaaaccagtgcgggcagtgagttgggggaagctgagcaggagggagagggcataagtgaaaggggagaaactgggggtcaaggctctgggcatgaggacaacttgcagggtgaagctgcggcaggaggtgaccaagatccaggacagagtgatggggccgaaggcatagaggccccggaggctgaaggggaggcccagccagagtcagaaggtgtagaggccccagaggcagaaggggatgcccaggaggctgaaggggaggcccagccagagtcagaagatgtagaggccccagaggcagaaggagaggcccagccagagtcagaagatgtagagaccccagaggcagaatgggaggtccagccagagtcagaaggtgcagaagccccggaggcagaaaaggaggcccagccagagacagaaagtgtagaggccctggagactgaaggggaggacgagccagagtcagaaggtgcagaggcccaagaggcagaagaggcggcccaggaggcagaagggcagacccagccagagtcagaagttatagagtcccaggaggcagaagaggaagcccagccagagtcagaagatgtagaggccctggaggttgaagtggagacccaggaggcagaaggggaggcccagccagagtcagaagatgtagaggccccagaggctgaaggggagatgcaagaggcagaagaggaggcccagccagagtcagacggtgtagaggcccagccaaagtcagaaggtgaagaggcccaggaggttgaaggggagacccagaagacagaaggggatgcccagccagagtcagacggtgtagaggccccggaggcagaagaggaggcacaggaggctgaaggggaggtccaggaggcagaaggggaggcccacccagagtcagaagatgtagatgcccaggaggcagaaggggaggcccagccagaatcagaaggtgtagaggccccagaggcagaaggggaggcccagaaggcagaaggtatagaggccccagagactgaaggggaggcccagccagagtcagaaggtatagaggccccagaggctgaaggggaggcccagcctgagtcagaaggtgtagaggcccaggatgcagaaggggaggcccagccagagtcagaaggtatagaggcccaggaggctgaagaggaggcccaaccagagttagaaggtgtagaggccccagaggcagaaggggaggcccagccagagtcagaaggtatagaggccccagaggcagaaggggaggcccaaccagagttagaaggtgtagaggccccggaggctgaagaggaggcccagccagagccagaaggcgtagagaccccggaggctgaaggggaggcccagccagagtcagaaggagaaactcaaggtgagaaaaaggggagccctcaggtcagtctaggagatggccaatctgaggaggcttctgaaagcagcagcccagtccctgaggacaggcccactccacccccttccccaggtggagacactccccaccaaaggccaggctcccaaacaggcccttcctcctccagagcatcctcttggggcaactgctggcagaaagactcagaaaatgaccatgtacttggagacacaaggagccctgatgccaagtccacggggacccctcatgcagagaggaaggccaccaggatgtacccagaaagttctacttctgagcaagaagaggcccctttgggctcaaggactccagagcagggggccagtgaaggttatgacctacaagaggaccaggcactcggaagtctcgcccccactgaggcagtgggcagggcagacggctttggccaagatgacttagatttctagacaagatcaagctagaaaacaatcacgagcttgggagctctgtttttattcatattttttctacaaaactgagcaacgttcagtccactggagatgtccatagtacatggacaaagaccaaggacttgccaaggacacagcccatgccatgctgtcctgggactcttaagtccagaagtgtcagagagctctgcggcccgtcccacacgcagtgtgaagaaagggggtgtctgcggatctgcccggttatcggaggtcagcccggctcctatttatttgtctgcagagcccgaaagatggaactgattggaaaggctccagtttagcttttgtttgtgggtttgttttctgctagcaagtgttgctctctgtcttttccctgttgatctcctgttacttttctccttggcttctgttggcactcacctcatttgactttgaggtgctttttttctagtcttgaatatatttgatgactctgcagaaatacttgggcaaagcaggtaacttcagagtcattggataaagtttgttctcaactccaaa

SEQ ID NO: 26011 - DNA, 3803 bp, Homo sapiens
ggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggagcggccaaagcagtacagctgggatcagcgcgagaaggttgatccaaaagactacatgttcagtggactgaaggatgaaacagtaggtcgcttacctgggacggtagcaggacaacagtttctcattcaagactgtgagaactgtaacatctatatttttgatcactctgctacagttaccattgatgactgtactaactgcataatttttctgggacccgtgaaaggcagcgtgtttttccggaattgcagagattgcaagtgcacattagcctgccaacaatttcgtgtgcgagattgtagaaagctggaagtctttttgtgttgtgccactcaacccatcattgagtcttcctcaaatatcaaatttggatgttttcaatggtactatcctgaattagctttccagttcaaagatgcagggctaagtatcttcaacaatacatggagtaacattcatgactttacacctgtgtcaggagaactcaactggagccttcttccagaagatgctgtggttcaggactatgttcctatacctactaccgaagagctcaaagctgttcgtgtttccacagaagccaatagaagcattgttccaatatcccggggtcagagacagaagagcagcgatgaatcatgcttagtggtattatttgctggtgattacactattgcaaatgccagaaaactaattgatgagatggttggtaaaggctttttcctagttcagacaaaggaagtgtccatgaaagctgaggatgctcaaagggtttttcgggaaaaagcacctgacttccttcctcttctgaacaaaggtcctgttattgccttggagtttaatggggatggtgctgtagaagtatgtcaacttattgtaaacgagatattcaatgggaccaagatgtttgtatctgaaagcaaggagacggcatctggagatgtagacagcttctacaactttgctgatatacagatgggaatatgaagtgcaatgtggaaccaggacttggtattaagcctttcccaacttgtgaatatagaatttgataatacacttttgtgtattagcaatggtttttactaatgctaaaacttttaaagtttattttttaataaattgttgagtattacatcatttacttgaggttcaaaaataattcattttaaattaagtagttttaatcagcttaaaagctatttaacccattttaataagcttgcagttttgtttctctgcatatgatattcttattagaaaacagaagtagctaaaagtttattattttaatcctatttaaatgttctttcaaatctctaataatttaaactttcctcagtgctccatgatactttttttgagactccatatcattgcttattttacctttttcaatttagagggatttgttactagtcgatcaattagaatgaacctatgcacatttttatgtacacatatccagttatataattgcttcctagttgcattatatggcaaatgagattttgtacatggagttgacataatactttgtaaattgaattttttaaagaaataggcatttgataaccagcttggcaagtaactctactaacagatgttggtatagctatttaaagactacttcgtaagtagtatgattatttgaataaattacacattgtttagttttttaatacaactgctatatgactcttctgcttcctgataagaaaaggtatatgcaatgctaaaactgtagaagcccaatcaccagcagtttttaaaaaggtgataacttttattagctcttgtgggctatcaagagaattggaacaaaaccttgtgacttttaggtaagaaataggcatgatgataagctatgcagattattaaaaagcttgatacatttgatttttcattagatatgccattcatatcaagtaatgttcaagtatgataaaattattttggttgctttaaagcactgtttcccaaatctacctgatcataataatttaccaggaagcagaggagagctacttgtttaaaaatccacattcttggacccaatcctcagatgcacggattcagtcttcaggggaaactctgttttaaggggtatgttgtaatctaaagtaattggttcaggaggtgtcaataggttgaacttgtgagaaggcactgaatctgccatccacatcacatatagcagctattatgaaatcagctttcataggcctatttttaaaaggaatctgaaatttaattctattttgataaaactaagactgaaaataaccacttgtaaacattcctatgattgttactaaaatgtattttcatgtttaaaatgtttttggatatttttgggttaataactactacattgaattgcatgttaaggtgcagaaataatacattaaaagattttcactttaaattaattagtaatattgagcgctcaccctgtgcgtggccttgtgctaaccattagcactgcatcatttcaattcttttataagggcattcaatactacaaaatcaacatgatttcataaggtgcaaataaaagttggtgacagatttaatataattttgatcacaatttacaaatgatctttgcaaatagtggtcagacggcattagtttttcccttagttaagctaaattaaagggactccatcctgttatgattatattattattattattattattatttttgaggtggagtttcactcttgttgcccaagctggagtgcaatggcgcgatctcggctcaccacaacatccgcctcctgggttcaagcgattctcctgcctcagcctcctgagtagctgggaatacaggcatgcgccactacacctggctaatttttgtatttttagttgagatggggtttttccacgttggtcaggctggtctcgaactcctgacctcaggtgatccgtccacctcagcctcccaaagagctgggattacaggtgtgagctaccgcgcctggccatgatgatattattaaacaccattattcacatttcaaataataacaatactttttgtttttcaaaaataaaatgcaatgttatataaagctataaactaagttctttatgatatttgagcaacaactcaggaatataacatataagggagatgttaatttaaaaatttccactacacttattatctattaaccaaagcttaaaattttgtattcttctgttagataagaccttttacccatttaatttgtctttaaggacagtcatttggcttctgaatgtttgaaacgattttaaaaaataagtagtgctatggttgtttctataattctaacctttgatagtaatcagaatgtattacatttcatttctgaatagcttttgaatttatgaaaaattattaacaatgaaaaattggtaattttattaagttatatgtgtttaaatattatattagcttatttctcttgcattaatagtactgctgtttttgttttgcttctttatatttatgtctagcttttatatgtaatttatctagtgtttataaaatgtgatttgtaataaatgttgttaaaatgaaaa

SEQ ID NO: 26012 - DNA, 1121 bp, Homo sapiens
ggcgctgcgggggctgacatgtcgtcccggcctgggcgcgaggacgtgggggctgcgggcgcgcggcggccgcgtgagccgccggagcaggagctgcagcgacgtcgggagcagaagcggcggcgacacgacgcgcagcagctgcagcagctcaagcacctggagtccttttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggtggcaggactgggagaatctctgaggcgtgtcttccaggccctcccacagcttgtgccctccacagtgtggactcaggtcccatagacatcaggctggagtcttctctgttgttgagaataataaaagctcattatttattttttaaa

SEQ ID NO: 26013 - DNA, 2885 bp, Homo sapiens
gtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttcc

SEQ ID NO: 26014 - DNA, 2918 bp, Homo sapiens
aagctccgcccccgttgcccgtagcggctgtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtgg

SEQ ID NO: 26015 - DNA, 2979 bp, Homo sapiens
gtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttcc

SEQ ID NO: 26016 - DNA, 3686 bp, Homo sapiens
gtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtaggtaatgacacaggccaggtgggacctcaggctgacactgatggagagggtttacaaaaagaggtatatagacatgaaaataataatggtgttgatcaacttgatgctaaggaaatagaaaaggaaagtgatggaggacacagtcagaaggaatcagaagcagaagaaatagacagtgagaaggaaactaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgagagtcaacagggtatagctgatggattccagcagcctgaggcaatagaatttagtagtggagagaaagaggatgatgaagtggaaactgaccaaaacatacggtatggcaggaaattgattgaacaaggaaatgaaaaagagactaaacccataatatccaaatccatggcaaagtatgattttaaatgtgatcgcttgtcagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggatcatgaattttctaaaactgaggaactaaaactagaagatgtggatgaggaaattaatgctgaaaatgtggaaagcaagaagaaaactgtgggagatgatgaaagtgttcctacaggttatcacagtaaaacagaaggagcagaaagaaccaatgatgatagctcagctgaaactattgaaaagaaagaaaaagccaacctagaggaacgggccatttgtgagtacaatgaaaacccaaaaggatacatgcttgatgatgcagatagcagttcattagaaatcctagaaaacagtgaaacaacaccaagcaaagacatgaaaaaaacaaagaagatttttctgttcaaaagagtcccctcaataaatcaaaagattgtcaagaataacaatgagccgctcccagagataaaatccataggagaccagatcattttaaaaagtgataataaagatgccgaccagaaccacatgagtcagaatcatcagaatatcccaccaacaaatacagagagaagatcaaaatcctgtacaatactataaatatatatttatgttttcacagtcaccaagtgtattgtaatgtatacttgaaaaatgttataacttatgaagtaaagtttctgatagtagtctttaaaagatataagacttaatatgttttattcagcttctataagtgtgaccagttttgatatttatttatgctaatatttttaacaagtcatttcaaaatatgtgtatctcaaattctccctaaagtgttgtggccttaactgttcagtattgcaataaaaaatatatttttatatgtggaaaattgaaataagatatttcctagtttttactaaacaattttacttctttataattttataaggcaatatttgcaatcttacgacactgtaacagtttttgatgtatttacaatttttacaaaactgaggtaaaattgtttataatgaacatattttaataaactatatctggtcagttcc

SEQ ID NO: 26017 - DNA, 2109 bp, Homo sapiens
gtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagagtattctgccagtcactcccaaattgtttcagtttaa

SEQ ID NO: 26018 - DNA, 4767 bp, Homo sapiens
gtagcggctgtttgttgacttccgggagcgcggttgtagttgatctccggagtttcgccatgcggaacttgggggctttcgcggcccgcgtcggtgcggagtagctgctttagccccgaccaaaccgtcctctacagcctcctggccccggcgcaggctgcccgtactgcccgtggcatgagggagccggaagagctgatgcccgattcgggtgctgtgtttacatttgggaaaagtaaatttgctgaaaataatcccggtaaattctggtttaaaaatgatgtccctgtacatctttcatgtggagatgaacattctgctgttgttaccggaaataataaactttacatgtttggcagtaacaactggggtcagttaggattaggatcaaagtcagccatcagcaagccaacatgtgtcaaagctctaaaacctgaaaaagtgaaattagctgcctgtggaaggaaccacaccctggtgtcaacagaaggaggcaatgtatatgcaactggtggaaataatgaaggacagttggggcttggtgacaccgaagaaagaaacacttttcatgtaattagcttttttacatccgagcataagattaagcagctgtctgctggatctaatacttcagctgccctaactgaggatggaagactttttatgtggggtgacaattccgaagggcaaattggtttaaaaaatgtaagtaatgtctgtgtccctcagcaagtgaccattgggaaacctgtctcctggatctcttgtggatattaccattcagcttttgtaacaacagatggtgagctatatgtgtttggagaacctgagaatgggaagttaggtcttcccaatcagctcctgggcaatcacagaacaccccagctggtgtctgaaattccggagaaggtgatccaagtagcctgtggtggagagcatactgtggttctcacggagaatgctgtgtatacctttgggctgggacaatttggtcagctgggtcttggcacttttctttttgaaacttcagaacccaaagtcattgagaatattagggatcaaacaataagttatatttcttgtggagaaaatcacacagctttgataacagatatcggccttatgtatacttttggagatggtcgccacggaaaattaggacttggactggagaattttaccaatcacttcattcctactttgtgctctaattttttgaggtttatagttaaattggttgcttgtggtggatgtcacatggtagtttttgctgctcctcatcgtggtgtggcaaaagaaattgaattcgatgaaataaatgatacttgcttatctgtggcgacttttctgccgtatagcagtttaacctcaggaaatgtactgcagaggactctatcagcacgtatgcggcgaagagagagggagaggtctccagattctttttcaatgaggagaacactacctccaatagaagggactcttggcctttctgcttgttttctccccaattcagtctttccacgatgttctgagagaaacctccaagagagtgtcttatctgaacaggacctcatgcagccagaggaaccagattatttgctagatgaaatgaccaaagaagcagagatagataattcttcaactgtagaaagccttggagaaactactgatatcttaaacatgacacacatcatgagcctgaattccaatgaaaagtcattaaaattatcaccagttcagaaacaaaagaaacaacaaacaattggggaactgacgcaggatacagctcttactgaaaacgatgatagtgatgaatatgaagaaatgtcagaaatgaaagaagggaaagcatgtaaacaacatgtgtcacaagggattttcatgacgcagccagctacgactatcgaagcattttcagatgaggaagtagagatcccagaggagaaggaaggagcagaggattcaaaaggaaatggaatagaggagcaagaggtagaagcaaatgaggaaaatgtgaaggtgcatggaggaagaaaggagaaaacagagatcctatcagatgaccttacagacaaagcagaggtgagtgaaggcaaggcaaaatcagtgggagaagcagaggatgggcctgaaggtagaggggatggaacctgtgaggaaggtagttcaggagcagaacactggcaagatgaggagagggagaagggggagaaagacaagggtagaggagaaatggagaggccaggagagggagagaaggaactagcagagaaggaagaatggaagaagagggatggggaagagcaggagcaaaaggagagggagcagggccatcagaaggaaagaaaccaagagatggaggagggaggggaggaggagcatggagaaggagaagaagaggagggagacagagaagaggaagaagagaaggagggagaagggaaagaggaaggagaaggggaagaagtggagggagaacgtgaaaaggaggaaggagagaggaaaaaggaggaaagagcggggaaggaggagaaaggagaggaagaaggagaccaaggagagggggaagaggaggaaacagaggggagaggggaggaaaaagaggagggaggggaagtagagggaggggaagtagaggaggggaaaggagagagggaagaggaagaggaggagggtgagggggaagaggaggaaggggagggggaagaggaggaaggggagggggaagaggaggaaggagaagggaaaggggaggaagaaggggaagaaggagaaggggaggaagaaggggaggaaggagaaggggagggggaagaggaggaaggagaaggggagggagaagaggaaggagaaggggagggagaagaggaggaaggagaaggggagggagaagaggaaggagaaggggagggagaagaggaggaaggagaagggaaaggggaggaggaaggagaggaaggagaaggggagggggaagaggaggaaggagaaggggaaggggaggatggagaaggggagggggaagaggaggaaggagaatgggagggggaagaggaggaaggagaaggggagggggaagaggaaggagaaggggaaggggaggaaggagaaggggagggggaagaggaggaaggagaaggggagggggaagaggaggaaggggaagaagaaggggaggaagaaggagagggagaggaagaaggggagggagaaggggaggaagaagaggaaggggaagtggaaggggaggtggaaggggaggaaggagagggggaaggagaggaagaggaaggagaggaggaaggagaagaaagggaaaaggagggggaaggagaagaaaacaggaggaacagagaagaggaggaggaagaagaggggaagtatcaggagacaggcgaagaagagaatgaaaggcaggatggagaggagtacaaaaaagtgagcaaaataaaaggatctgtgaaatatggcaaacataaaacatatcaaaaaaagtcagttactaacacacagggaaatgggaaagagcagaggtccaaaatgccagtccagtcaaaacgacttttaaaaaacgggccatcaggttccaaaaagttctggaataatgtattaccacattacttggaattgaagtaacaaaccttaaatgtgacccgattatggccagtcagacaatttaaatgccttgcatataacgggcactcattacgtgttattaaattgattttatgtcaattattttatgtgtagtaaaaaaaaaagcaactgatgcagctgtgttaaggagccaaagacaataggaggcactggtaaattttggcctctctcaaactaaaattttcgtgtatttcccccccaaattataaaaacataactagaaaatattaaaaggtcatatcagattattaacattatatattcattaaaggcagctttaggaaacaggaatatactacaagagtgttttgtttgtgtatacaaatcattccatttttaaatggcacagatgcttaagggctataaaaacttctaatttcttataaatatgttagcactttttttaagttagtgattacagtttacctactgtatagaataattttctaataatggatggtattctaaaactcaattgaggcattcacattttaaagaaagtattgtctttcaccttttatgtgttctttttgcaaaaatctacaaagtgacagctgtgttcagagcttagatcccaaaaacgtgatctcttttagttactatctgggcagatggtagtatatctaatgaaatggtgattaatttaaatgtataatctggaaatatgtaaaacttgaagtattttttgtccaggcaaaggtactcattgggcctcagtttcttcatctctaaaatggagtggatgagatgatgtgataactgcagtcccttctaactcttaaattcttttcattctcacagattcactctatcattattgttattcatgtaagaaacgttttagggagaaaaattacactttaaaattaatttagttttctatacagttgttttctttactcttgaaaagttatgacagctttaacgtctcttgtcttctgtaattttttatttctaaactcctatcatttccaagctttaactgtactttatcagagccttcatttctggtatgtgttatatgccctcaatgtattcactgactgttctgtaatttcagtttgtctgttccttgtcagaatgtttcaagtaaaataaaaaattaaatgt

SEQ ID NO: 26019 - DNA, 3944 bp, Homo sapiens
atgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgccggagaaacccaagagggggccaagggacaggctgagctacacagcccctccatcgtttaaggagcatgcgacaaatgaaaacagaggtgaagtagccagtaaacccagtgaacttgtttctggttctaacagcataatttctttcagcagtgtcataagtatggctaaacccattggtctatgcatgcctaacagtgcccacatcatggccagcaataccatgcaagtggaagagccacccaagtctcctgagaaaatgtggcctaaagatgaaaattttgaacagagaagctcattggagtgtgctcagaaggctgcagagcttcgagcttccattaaagagaaggtagagctgattcgacttaagaagctcttacatgaaagaaatgcttcattggttatgacaaaagcacaattaacagaagttcaagaggcatgtactttccttttgacccagaatcagggaatcctgagtgcagcccatgaggccctcctcaagcaagtgaatgagctcagggcagagctgaaggaagaaagcaagaaggctgtgagcttgaagagccaactggaagatgtgtctatcttgcagatgactctgaaggagtttcaggagagagttgaagatttggaaaaagaacgaaaattgctgaatgacaattatgacaaactcttagaaagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatg

SEQ ID NO: 26020 - DNA, 2021 bp, Homo sapiens
atgttgcttatggcacccgaccgttgtcgttatgtttggaaacactgccagcccatggagatgaggataaagtggatatttctctgctgcatcaggcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatg

SEQ ID NO: 26021 - DNA, 2004 bp, Homo sapiens
agttggtaaatgacagttatgaataaagcaagggcagaaaaaaacatgtaggggagagaatgaggaactaggtccaggagatgctgaaactggataataaagacgtcatatcacaccccttggggtatccatctgagagcttgctttccattgccagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataacatgaa

SEQ ID NO: 26022 - DNA, 3940 bp, Homo sapiens
atgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggccgggacctgcgggtcgcggaggaggcggcgccgctctcggagaccgcaaggcgcgggcagaaggcgggatggcggcagcgcctctccatgcaccagcgcccccagatgcaccgactgcaagggcatttccactgcgtcggccctgccagcccccgccgcgcccagcctcgcgtccaagtgggacacagacagctccacacagccggtgcaccggtgccggagaaacccaagagggggccaagggacaggctgagctacacagcccctccatcgtttaaggagcatgcgacaaatgaaaacagaggtgaagtagccagtaaacccagtgaacttgtttctggttctaacagcataatttctttcagcagtgtcataagtatggctaaacccattggtctatgcatgcctaacagtgcccacatcatggccagcaataccatgcaagtggaagagccacccaagtctcctgagaaaatgtggcctaaagatgaaaattttgaacagagaagctcattggagtgtgctcagaaggctgcagagcttcgagcttccattaaagagaaggtagagctgattcgacttaagaagctcttacatgaaagaaatgcttcattggttatgacaaaagcacaattaacagaagttcaagaggcatacgaaaccttgctccagaagaatcagggaatcctgagtgcagcccatgaggccctcctcaagcaagtgaatgagctcagggcagagctgaaggaagaaagcaagaaggctgtgagcttgaagagccaactggaagatgtgtctatcttgcagatgactctgaaggagtttcaggagagagttgaagatttggaaaaagaacgaaaattgctgaatgacaattatgacaaactcttagaaagcatgctggacagcagtgacagctccagtcagccccactggagcaacgagctcatagcggaacagctacagcagcaagtctctcagctgcaggatcagctggatgctgagctggaggacaagagaaaagttttacttgagctgtccagggagaaagcccaaaatgaggatctgaagcttgaagtcaccaacatacttcagaagcataaacaggaagtagagctcctccaaaatgcagccacaatttcccaacctcctgacaggcaatctgaaccagccactcacccagctgtattgcaagagaacactcagatcgagccaagtgaacccaaaaaccaagaagaaaagaaactgtcccaggtgctaaatgagttgcaagtatcacacgcagagaccacattggaactagaaaagaccagggacatgcttattctgcagcgcaaaatcaacgtgtgttatcaggaggaactggaggcaatgatgacaaaagctgacaatgataatagagatcacaaagaaaagctggagaggttgactcgactactagacctcaagaataaccgtatcaagcagctggaaggtattttaagaagccatgaccttccaacatctgaacagctcaaagatgttgcttatggcacccgaccgttgtcgttatgtttggaaacactgccagcccatggagatgaggataaagtggatatttctctgctgcatcagggtgagaatctttttgaactgcacatccaccaggccttcctgacatctgccgccctagctcaggctggagatacccaacctaccactttctgcacctattccttctatgactttgaaacccactgtaccccattatctgtggggccacagcccctctatgacttcacctcccagtatgtgatggagacagattcgcttttcttacactaccttcaagaggcttcagcccggcttgacatacaccaggccatggccagtgaacacagcactcttgctgcaggatggatttgctttgacagggtgctagagactgtggagaaagtccatggcttggccacactgattggagctggtggagaagagttcggggttctagagtactggatgaggctgcgtttccccataaaacccagcctacaggcgtgcaataaacgaaagaaagcccaggtctacctgtcaaccgatgtgcttggaggccggaaggcccaggaagaggagttcagatcggagtcttgggaacctcagaacgagctgtggattgaaatcaccaagtgctgtggcctccggagtcgatggctgggaactcaacccagtccatatgctgtgtaccgcttcttcaccttttctgaccatgacactgccatcattccagccagtaacaacccctactttagagaccaggctcgattcccagtgcttgtgacctctgacctggaccattatctgagacgggaggccttgtctatacatgtttttgatgatgaagacttagagcctggctcgtatcttggccgagcccgagtgcctttactgcctcttgcaaaaaatgaatctatcaaaggtgattttaacctcactgaccctgcagagaaacccaacggatctattcaagtgcaactggattggaagtttccctacataccccctgagagcttcctgaaaccagaagctcagactaaggggaaggataccaaggacagttcaaagatctcatctgaagaggaaaaggcttcatttccttcccaggatcagatggcatctcctgaggttcccattgaagctggccagtatcgatctaagagaaaacctcctcatgggggagaaagaaaggagaaggagcaccaggttgtgagctactcaagaagaaaacatggcaaaagaataggtgttcaaggaaagaatagaatggagtatcttagccttaacatcttaaatggaaatacaccagagcaggtgaattacactgagtggaagttctcagagactaacagcttcataggtgatggctttaaaaatcagcacgaggaagaggaaatgacattatcccattcagcactgaaacagaaggaacctctacatcctgtaaatgacaaagaatcctctgaacaaggttctgaagtcagtgaagcacaaactaccgacagtgatgatgtcatagtgccacccatgtctcagaaatatcctaaggcagattcagagaagatgtgcattgaaattgtctccctggccttctacccagaggcagaagtgatgtctgatgagaacataaaacaggtgtatgtggagtacaaattctacgacctacccttgtcggagacagagactccagtgtccctaaggaagcctagggcaggagaagaaatccactttcactttagcaaggtaatagacctggacccacaggagcagcaaggccgaaggcggtttctgttcgacatgctgaatggacaagatcctgatcaaggacatttaaagtttacagtggtaagtgatcctctggatgaagaaaagaaagaatgtgaagaagtgggatatgcatatcttcaactgtggcagatcctggagtcaggaagagatattctagagcaagagctagacattgttagccctgaagatctggctaccccaataggaaggctgaaggtttcccttcaagcagctgctgtcctccatgctatttacaaggagatgactgaagatttgttttcatgaaggaacaagtgctattccaatctaaaagtctctgagggaaccatagtaaaaagtctcttataaagttagcttgctataa

SEQ ID NO: 26023 - DNA, 4404 bp, Homo sapiens
gcggggccttctaaggccgaaagtcttcggagcttgcgccagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcagaaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagagtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccacgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgtttattaaagaa

SEQ ID NO: 26024 - DNA, 4290 bp, Homo sapiens
gcggggccttctaaggccgaaagtcttcggagcttgcgccagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcagaaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagagtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccacgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgtttattaaagaa

SEQ ID NO: 26025 - DNA, 6229 bp, Homo sapiens
gagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagaggaaaagaaaaagtccaagctagatgagtttacaaatgattttgctaaggaattgatggaatacaaaaagattcaaaaggagcgtaggcgctcattttccaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaa

SEQ ID NO: 26026 - DNA, 5739 bp, Homo sapiens
agtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgggattctgataataaaatattgccagctgcagctcttgcatcagagcactcaaagggaacctcctcaattgcaattaccgctcttatggaagagaagggttaccaggtgcctgttcttggaaccccatctttgcttggacagtcattattgcatggacagttgatccccacaactggtccagtaagaataaatactgctcgtccaggtggtggtcgaccaggctgggaacattccaacaaacttggctatctggtttctccaccacaacaaattagaagaggggagaggagctgctacagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaa

SEQ ID NO: 26027 - DNA, 4314 bp, Homo sapiens
gccaggccgcgtccgccatagtacctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcaattgatgactcttccgcgtctatttctctggcccagcttacaaagactgccaatctggctgaagccaatgcttctgaagaagataaaattaaagcaatgatgtcgcaatctggccatgaatacgacccaatcaattacatgaagaaacctctaggtccaccacctccatcttacacgtgtttccgttgtggtaaacctggacattatattaagaattgcccaacaaatggggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtataagaacagcactcctggaatcagatgagcacacatgtccgacgtgtcatcaaaatgatgtttctcctgatgctttaattgccaataaatttttacgacaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcgtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttc

SEQ ID NO: 26028 - DNA, 1762 bp, Homo sapiens
gccaggccgcgtccgccatagtacctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgt

SEQ ID NO: 26029 - DNA, 2036 bp, Homo sapiens
gcgggacgggaccgccgcgccgagggctccgagcacttccggagccgggcgcggggccgagggctgggcccccctcttcccttccctcctccagcggctgcgctccctccggcgccctcggccccggggcggaggcggcccccgccgctgggaagcgagcgccgcggctctttctacgcgcgcgcgcgcgttgaccgcctcggggtcgcggcccttgtccgggggttgctggggtcctcaggcctatggctgccgaggcgggcgtcgtgggagctggggcctcccctgatggggattggagagaccaggcctgtgggcttctgctacacgtgcatttgtcttcccgactgggtcgcgcagcccctgtacgtacaggtcgtcatcttagaacagtgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaat

SEQ ID NO: 26030 - DNA, 2333 bp, Homo sapiens
ggtctcggcgccggagccgttggctcccagacccgcctctccgcctcctctcacttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtgaatttggtggctttggttctgtaacaggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacacttcttgattggctttgcagaaataaagttttaaaataaaacttgtgtttttttaaaagcttagtgggggggggcgggggagtctactttttgagtagaaatgggtaaaatggtacctttggactcctacagttaaggtcacatggataatgaaagaatacacagaagctgttaagtttatcatacatatttacttaatctatacagaatcaagtagataaaatcagattcacattagtgaaaaatctctacaaaatgtctttgaaaagcaaaacgagactgcctcttaacaattcgtatcctcatgaaagacgtgggctgtaaaaataaagcagtgtgtttagcacaaa

SEQ ID NO: 26031 - DNA, 1904 bp, Homo sapiens
cttttcccagggcggatgcgcctgcgctcagctgcctgggcgggctgggaggcgcgggttgaaaagtctcgttccaagtttggagagagagagaagagcgcctcagacctcggtacccgcgagcggggaggaggcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagatggcgagtaaagagatgtttgaagatactgtggaggagcgtgtcatcaatgaagaatataaaatctggaagaagaatacaccgtttctatatgacctggttatgacccatgctcttcagtggcccagtcttaccgttcagtggcttcctgaagtgactaaacctgaaggaaaagattatgcccttcattggctagtgctggggactcatacgtctgatgagcagaatcatctggtggttgctcgagtacatattcccaatgatgatgcacagtttgatgcttcccattgtgacagtgacaagggtggaaaaattgaatgtgaaattaaaatcaatcacgaaggagaagtaaaccgtgctcgttacatgccgcagaatcctcacatcattgctacaaaaacaccatcttctgatgtgttggtttttgactatacaaaacaccctgctaaaccagacccaagtggagaatgtaatcctgatctcagattaagaggtcaccagaaggaaggctatggtctctcctggaattcaaatttgagtggacatctcctaagtgcatctgatgaccatactgtttgtctgtgggatataaacgcaggaccaaaagaaggcaaaattgtggatgctaaagccatctttactggccactcagctgttgtagaggatgtggcctggcacctgctgcacgagtcattgtttggatctgttgctgatgatcagaaacttatgatatgggacaccaggtccaataccacctccaagccgagtcacttggtggatgcgcacactgccgaagtcaactgcctctcattcaatccctacagcgaatttattctagccaccggctctgcggataagaccgtagctttatgggatctgcgtaacttaaaattaaaactccataccttcgaatctcataaagatgaaattttccaggtccactggtctccacataatgaaactattctggcttcaagtggtactgaccgccgcctgaatgtgtgggatttaagtaaaattggggaagaacaatcagcagaagatgcagaagatgggcctccagaactcctgtttattcatggaggacacactgctaagatttcagattttagctggaaccccaatgagccttgggtcatttgctcagtgtctgaggataacatcatgcagatatggcaaatggctgaaaatatttacaatgatgaagagtcagatgtcacgacatccgaactggagggacaaggatcttaaacccaaagtacgagaaatgtttctgttgaatgtaatgctacatgaatgcttgatttatcaagcgccaaaaaggcattgtatagtaggaaatgtaagtggggtggcttatggcttctttatcctctgattctagcactttcaagtgagctgttgcgtactgtatcatattgtagctattagggaagagaagaatgttgcttaagaaagaacatcaccattgattttaaatacaagtagcagggtattgcctttgattcaactgttttaagtcctcattttctcaaactaagtgcttgctgttcccaaatatgcaagaataacttttacactttttccttccaacac

SEQ ID NO: 26032 - DNA, 3861 bp, Homo sapiens
cgcaggctccctgcgggagcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatatacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggccaggtgtttgaggccagccagggcaacacagcaagaccccatctctacaaaatattaaaacattagctaggcatggtggtgcacacctgtagtcctagcttcttgggaggctgaggcaggattgcttgagcccaggagtttgagccttcagtgagctatgatcgcgccactgtactccatcctgggtgatggagcgaagaacctgtctcttaaaaaaaaaaatttttttttaattaaaaaaacccaccctttttcatttcccaacattttttggctattatgatcgctatgtgttccttcaaataatttccagtgaatccacacttgatgttgcaaagcctaagtttgctgcagaaatacaatttcctacacttcatacctaaaggagattcagagctatcgctcaaaaccaaaagtcttggtttttaaatgtgcttagacaaaaaaaatcaggaaaggtaccctaatcgttcaacagcaatcatctttggggaatgggcattttggtaggtaaagtgtggtggacgtccttattattatttttgagacagtgtcttgctctgtctcccaggctggaggtcagtggcacaaatctcagctcactctaacctgcacctcccgggttcaagtgattctcatctcagcctcccaagtagtgtgaactaaaggcatgtgccaccacgcctggctaatttttgtatttttagtagagacagggtttcaccatgttggccaggctggtctcgaactcctggcctcaagtgatccacccacctcagccgcccaaagtgttgggattacaggcatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaa

SEQ ID NO: 26033 - DNA, 543 bp, Homo sapiens
gggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgattggaaaccaaattgcacaaattcactgactgtggccactttcagaacacagagtttcatgaactga

SEQ ID NO: 26034 - DNA, 802 bp, Homo sapiens
gatttcatcttccaggatccaccttgattaaatctcttgtccccagccctcctggtccccaatggcagcagccgccatcccagctttgcttctgtgcctcccgcttctgttcctgctgttcggctggtcccgggctaggcgagacgaccctcactctctttgctatgacatcaccgtcatccctaagttcagacctggaccacggtggtgtgcggttcaaggccaggtggatgaaaagacttttcttcactatgactgtggcaacaagacagtcacacccgtcagtcccctggggaagaaactaaatgtcacaatggcctggaaagcacagaacccagtactgagagaggtggtggacatacttacagagcaactgcttgacattcagctggagaattacacacccaaggaacccctcaccctgcaggcaaggatgtcttgtgagcagaaagctgaaggacacagcagtggatcttggcagttcagtatcgatggacagaccttcctactctttgactcagagaagagaatgtggacaacggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctga

SEQ ID NO: 26035 - DNA, 1285 bp, Homo sapiens
atggcagcagccgccatcccagctttgcttctgtgcctcccgcttctgttcctgctgttcggctggtcccgggctaggcgagacgaccctcactctctttgctatgacatcaccgtcatccctaagttcagacctggaccacggtggtgtgcggttcaaggccaggtggatgaaaagacttttcttcactatgactgtggcaacaagacagtcacacccgtcagtcccctggggaagaaactaaatgtcacaatggcctggaaagcacagaacccagtactgagagaggtggtggacatacttacagagcaactgcttgacattcagctggagaattacacacccaaggaacccctcaccctgcaggcaaggatgtcttgtgagcagaaagctgaaggacacagcagtggatcttggcagttcagtatcgatggacagaccttcctactctttgactcagagaagagaatgtggacaacggttcatcctggagccagaaagatgaaagaaaagtgggagaatgacaaggatgtggccatgtccttccattacatctcaatgggagactgcataggatggcttgaggacttcttgatgggcatggacagcaccctggagccaagtgcaggagcaccactcgccatgtcctcaggcacaacccaactcagggccacagccaccaccctcatcctttgctgcctcctcatcatcctcccctgcttcatcctccctggcatctgaggagagtcctttagagtgacaggttaaagatgataccaaaaagcccctgtgagcacggtcttgatcaacctcgcccttctgtctggccagctgcccaccacctacggtgtatgtccagcagcctccagcagatgatgatgacaccatggacccaatagctcattcactgccttgattccttttgccaacaatttaaccagtgattattcctaacatattatgcaattttctcttggtgctacctgatggaattcctgcacttaaagttctggctgactaaacaagatatgtcaacattttctttcttctctttttgtttggaaaatcaagtacttctttgaatgatgatttctttctttcattactgacatgattgtcagtaaaacaatcatgttagacttcagacctccagggattctttccatgtcctgaaagagaattgtttaattatttaataagaaaaaaatttatattaatgattgtttcctttagtaatttattgctgtgtactgatatttaaataaagagttatatttcccaaaaa

SEQ ID NO: 26036 - DNA, 4923 bp, Homo sapiens
atgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgagcccagcctgggagcgcaaaacccaagaagcggccagaacgcacctccggctccggcggacgcgcgaccgttgtgcaccaccagggaccgccgcgcctactctgcacgggagcagggacagcgctag

SEQ ID NO: 26037 - DNA, 5662 bp, Homo sapiens
atgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccaggggtggtgggcagggcactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacaacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcactgggtgcatgaggcctgtgccgtgtggaccggcggcgtctacctggtggccgggaagctctttgggctgcaggaggccatgaaggtggccgtggacatgcacggtggcactgtggctctggcgcctggtgacttctccctccccggcctcaggtttgcttcactcttccaagggccttcttggtgtgactgtcctgtcctggccacgtccactccaagcagctggtccagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtgg

SEQ ID NO: 26038 - DNA, 7662 bp, Homo sapiens
cccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaa

SEQ ID NO: 26039 - DNA, 2901 bp, Homo sapiens
atgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgaggcctcgttatatagtgtatatatatgtatacatatacatatatataatatatatgaagactgtaaatgttaa

SEQ ID NO: 26040 - DNA, 2928 bp, Homo sapiens
ctgagatttagccgtgcgatgcccgcgcaggggcgggggccgcgggccaggggaggcgctcagagtccggagccgccgagcgagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttga

SEQ ID NO: 26041 - DNA, 6060 bp, Homo sapiens
atgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgcacggtggcactgtggctctggcgcctggtgacttctccctccccggcctcaggtttgcttcactcttccaagggccttcttggtgtgactgtcctgtcctggccacgtccactccaagcagctggtccagatgtgttccagctgccaagaagccggggccaccattgggtgctgccacaaaggatgcctccacacctaccactacccgtgtgccagcgatgcaggtacgagcccgcccaggaacaggagggcattggagcccatccaagcagtccagggggaccctccctgggcacagctccccaaacccaggccccatctcactcttcagtttccctcctctcttgccccagcaattcttttatccttctgtctgcctagacctctgctgggcaatgccagggacatggaaatgaggcattccccaggcacctgcttgaggagtgcccagagcagtgagggaagatagaagcataaattacaatgtggaatgc

SEQ ID NO: 26042 - DNA, 5092 bp, Homo sapiens
atccaggtcggcgggggccggcgcccggcggccacgtggtggtgctgccgctgcccccgccccgccggcctagcccgggagctcggcgcccactgacccccgcagcgggggaggaggagggactgcggcgcaggaagccgagcaggaagcgagcccggcggccgcgttttcctggggaagcggcgggcggggtggagcagccagctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcatttctggtgttgatt

SEQ ID NO: 26043 - DNA, 4768 bp, Homo sapiens
atggtgaaggggaagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 26044 - DNA, 5064 bp, Homo sapiens
gatggggtgagtgcgcggcacggagttgggaggctcccggcgcggggtcccgggctcgtgtccccgcctttgtgtctggagctcgggcgcgggaggcgctggggacggcgcccgggcggagcggctgagcgggctgcagccggggtcccgccacctctccctggtccaccgccggcagcccactgtctgcggagagcagatctggggacaagaggaaggagaggaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctttgtgttagatccagagttgtcggcagccgctgccattgttctcattcgtggtatgcactgtggcctagcgtagcttcttccctttccaaaggtttctgaggacttctcccaggagaagactgcccgcctcagaactgcttagagacttcaaaccagcagaggtgaaagtccctgtcatcccttcagattccagagctgggatcagccatgcccagaggtctggtcctgatgctggcaggggggccccctcctccatccctgactggctgagtggctttatcaccaccgagtgatgtgctgaggcctcctgcagtgaatgctccttccattcctgtactcgggcagtgccattcagcacaggagagctctttttgcctttggctttcaattccaaaacatgatttaatttctaactaaattagtatggcactagttatgaagtatctgcttaaaacccttcatcatgatatcctgtggatttaaaaactctaattccatgttttcttcccatctgccttatatatctcatcaccctgcttatcaatattcagtttgatgagcactattaactaaaatatgaaacttaaaaacaaaagcaagttgtccttaaaagttctttttttaagtaaattgttgacatactgcaaattttctatgcaaacttgcctcctgctgttatctgtgaagctcaggaaatccaaacatttgtgtttcaacaagggacagtaaactgtgtgtttacagccaaaagaaatgcctcatagttcttaacctcaacttttgtagaagtatttttttctctgtaatatttttattggctcataaagatgttttcatatctgaactcctaaataagtgaaattacagtagattatattaacaaaatactttttaggtagccatgcttgagactttttaaaaatataactttttccttaaagttttcagctatagcaaaaggtagttatgtatgccagacctaatatgagctgccaccaacacccctagaactttcagccatggtgtcttcagaattgtagcgcatttctgaatctagcaaatcctccttttacccgttgaatgttttgaatgccctgactctaccagcgcccataaatgatctctagaaggactgttagtaccaatctgtttttcaactttgaagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgc

SEQ ID NO: 26045 - DNA, 3339 bp, Homo sapiens
actcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaactacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtc

SEQ ID NO: 26046 - DNA, 630 bp, Homo sapiens
aagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaagtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagt

SEQ ID NO: 26047 - DNA, 3091 bp, Homo sapiens
gggagaaaaacatagcagaggggttgtacacgataatatttttttaaaaggtcaccccataaacccttctatgatcccagtcttgtattagctgcattccagatactttgagcagagttgtggagtgggagaaattaatggaagggaattagatggaagccaagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggac

SEQ ID NO: 26048 - DNA, 579 bp, Homo sapiens
gttgctacttctgtgaaatgaggcacttagactagatgagcaatcttgacttttgaagggtggcaactaccttgtagaatccagtgaaaactcagaaccttcctccctgaaaaatgtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctg

SEQ ID NO: 26049 - DNA, 542 bp, Homo sapiens
aaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcag

SEQ ID NO: 26050 - DNA, 554 bp, Homo sapiens
aaggatgcagcgtttcagttaagaggaatagatgaagagatctattgtacaacatggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttg

SEQ ID NO: 26051 - DNA, 548 bp, Homo sapiens
agcagccagctgggtccggggagcgccgccgccgcctcgatggggtaacctctaatgtgaagttagcgcacacagttctcaagcatgtttggaactacactgtatccacaaaaaaatacatgtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcag

SEQ ID NO: 26052 - DNA, 575 bp, Homo sapiens
atggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggagctacatgcgaagttttcacatcttgtacatttccaaatttaatgaaaaaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagc

SEQ ID NO: 26053 - DNA, 660 bp, Homo sapiens
cgcgttttcctggggaagcggcgggcggggtggagcagccagctgggtccggggagcgccgccgccgcctcgatggggatctcgctctgtcccttaggctggagtgcagtggtgcaatcttagctcaccgcagccttgacctcctgggctcaagcagtcctcccaccttagcctccctggagctggcactacaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcg

SEQ ID NO: 26054 - DNA, 542 bp, Homo sapiens
gagatgcaccctggagtctgcgccgggtcccacctgtttcgccccgcgcggcgcctcgctgcccccgcgtcggtgctgctgagcccaatccgcctcccggctgaacttggaggaggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcag

SEQ ID NO: 26055 - DNA, 3486 bp, Homo sapiens
ggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaactacatgcgaagttttcacatcttgtacatttccaaatttaatgaaaaaggtgttgaaaagtctcctctagagctttggaaggctgaatgcactaaacatgaagagcttgaaagcgaagttcaggaagagtgacgtaaattaaataaaactcatagagtgcaaagagacttcgacaaagacagaaaactagctgttggccagagtgaaagtcctggtcatccgacttccgagaaacctccttcaacctcatcgtctgctggctgtatgttatgcagcctacatatctcccgtggctttcagctaaggagaaaaagaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagcatgaccaagtctctaaaataagctcagaaagaagtggaactccaaaaaaacgcaaagctccaccacctcctatcagtcctacccagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaaagtggattccttggcaggacactgccccttgtcatctgtctt

SEQ ID NO: 26056 - DNA, 2941 bp, Homo sapiens
agctgggtccggggagcgccgccgccgcctcgatggggtgttgaaaagtctcctctagagctttggaaggctgaatgcactaaacatgaagagcttgaaagcgaagttcaggaagagtgacaccaatgagtggaacaagaatgatgaccggctactgcaggccgtggagaatggagatgcggagaaggtggcctcactgctcggcaagaagggggccagtgccaccaaacacgacagtgagggcaagaccgctttccatcttgctgctgcaaaaggacacgtggaatgcctcagggtcatgattacacatggtgtggatgtgacagcccaagatactaccggacacagcgccttacatctcgcagccaagaacagccaccatgaatgcatcaggaagctgcttcagtctaaatgcccagccgaaagtgtcgacagctctgggaaaacagctttacattatgcagcggctcagggctgccttcaagctgtgcagattctctgcgaacacaagagccccataaacctcaaagatttggatgggaatataccgctgcttcttgctgtacaaaatggtcacagtgagatctgtcactttctcctggatcatggagcagatgtcaattccaggaacaaaagtggaagaactgctctcatgctggcctgtgagattggcagctctaacgctgtggaagccttaattaaaaagggtgcagacctaaaccttgtagattctcttggatacaatgccttacattattccaaactctcagaaaatgcaggaattcaaagccttctattatcaaaaatctctcaggatgctgatttaaagaccccaacaaaaccaaagcagttgagtgatgtctcttccccaagatcaataacttcgactccactatcgggaaaggaatcggtattttttgctgaaccacccttcaaggctgagatcagttctatacgagaaaacaaagacagactaagtgacagtactacaggtgctgatagcttattggatataagttctgaagctgaccaacaagatcttctctctctattgcaagcaaaagttgcttcccttaccttacacaataaggagttacaagataaattacaggccaaatcacccaaggaggcggaagcagacctaagctttgactcataccattccacccaaactgacttgggcccatccctgggaaaacctggtgaaacctctcccccagactccaaatcatctccatctgtcttaatacattctttaggtaaatccactactgacaatgatgtcagaattcagcaactgcaagagattttgcaagatctacagaagagattagagagctctgaagcagagagaaaacagctacaggtcgaactccaatcccgaagggcagaactggtatgcttaaacaacactgagatttcagagaacagctctgacctcagccagaaacttaaagaaactcagagcaaatacgaggaggctatgaaagaagtccttagtgtgcagaagcagatgaaactcggtcttgtctcacctgaaagcatggataattattcacatttccacgagctgagggtcacggaagaggaaataaatgtgctaaagcaggatctgcagaatgcattagaagaaagtgaaagaaataaagagaaagtgagagagttagaggaaaaactggtagagagggagaaaggtacagtgattaagccacctgtggaagagtacgaggaaatgaaaagttcatattgctctgttattgagaatatgaataaggagaaagcatttttgtttgagaaataccaagaagcccaagaagaaatcatgaaattaaaagacacactaaaaagtcagatgacacaggaagccagtgatgaagctgaggacatgaaagaagccatgaataggatgatagatgaactcaataaacaggtgagcgagctgtcacagctgtacaaagaagcccaggctgagctggaggattacaggaagaggaaatctctagaggatgtcacagctgaatatatccataaagcagagcatgagaaactgatgcaattgacaaacgtgtccagggctaaagcagaagatgcactgtctgaaatgaagtctcagtattcaaaagtgttgaatgagttgacccagctcaaacaactggtggatgcacaaaaagagaactctgtctctatcacagaacatttgcaagtgataaccacgctgcggactgcagcaaaagagatggaagaaaaaataagcaatcttaaggaacaccttgcaagcaaggaagtggaagtagcaaagctggagaaacaactcttagaagagaaagctgctatgactgatgcaatggtacctcggtcttcctatgaaaaactccagtcatccttagagagtgaagtgagtgtgttggcatcgaaattaaaggaatctgtgaaagagaaagagaaggtccattcagaggttgtccagattagaagtgaggtctcacaggtgaaaagagaaaaggaaaatattcagactctcttgaaatccaaagagcaagaagtaaatgaacttctgcaaaaattccagcaagctcaggaagaacttgcagaaatgaaaagatacgctgagagctcttcaaaactggaggaagataaagataaaaagataaatgagatgtcgaaggaagtcaccaaattgaaggaggccttgaacagcctctcccagctctcctactcaacaagctcatccaaaaggcagagtcagcagctggaggcgctgcagcagcaagtcaaacagctccagaaccagctggcggaatgcaagaaacaacaccaggaggtcatatcagtttacagaatgcatcttctgtatgctgtgcagggccagatggatgaagatgtccagaaagtactgaagcaaatccttaccatgtgtaaaaaccagtctcaaaagaagtaa

SEQ ID NO: 26057 - DNA, 2317 bp, Homo sapiens
agcgactcggtgacagcggcgacggcggctcccaccgcggcgcacccccttcaggcggccggcggcgaggccagaccggagagttccagcacactcgaccaccccgcggcttcctggaggcggcggccgcgattgcgaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 26058 - DNA, 2377 bp, Homo sapiens
ggcaccgcaccgggcagtctccggatctgccgttctgccccggcccggaaaacccggcgccttccaggcccttcgaaagatggattctgttgacgtatctggcggccctggcgagcctggtggaaagttgggttttgccagattgcgccgggctcctctttgtgacgcgcggccagccccgcatcccccccggagccgggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 26059 - DNA, 2074 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 26060 - DNA, 2224 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 26061 - DNA, 2421 bp, Homo sapiens
cttggtgtatatagtaaaggccgggcgccgcacgcagacacacactcgccaggacacaggcgcacacacgctcacgcacaaccagcagcggcggcggcgacagcgactcggtgacagcggcgacggcggctcccaccgcggcgcacccccttcaggcggccggcggcgaggccagaccggagagttccagcacactcgaccaccccgcggcttcctggaggcggcggccgcgattgcgagcaggcttcccaggaagaatgaagcagtcaacttgcataaggcctgtcttgacttctctcctttgggggaagaggatcacattaagaagggtggcaggcttgcctggacacagaattccactaccaaacagacatcatttctgagaacttcagagtttatgatccaggtttcccagtgattaaattactccttggaaggccaagtggcatcagagctgagtgatggacgacctgcagtcccagaacctctccatggacatgactgactcccctcctgccttggctaataacagactggagaatggcatggctcagctgatcaccaccgaggcctggaacatcaactccactgacctggtaaagaaggccctggtgaccgtgccagccccatccattctgaacccccctgccgagtctcagagtggcatggctctgaaggtggcggccactgtgttgcagcccctgtgcctcggggagagcccagtggtgatgcccattcacatgcaggtggagggaagctccgcaccagagctcaatccgaatggcaatgccacctacgtcatgaccacccagggccccgtgcaactgcccgtggtgctggagcagcacgtctttcagcacctcaactcccctctggtcctgccgcaggaggccccatgctcctccagtaccatccacaacaacctcttccagggagcggaggaccccgaggcccagccccagctcctggacctgaggatccccagccagccgcaggagcccactttgccatttgaagctgtgctccagaatttgtttccctcccagggcactctcgggcccccaccctgtcagcctcctcctggctatgcccctgtgcccccacagccttttagctcccccttgtcccccctggtcccaccagccaccctcttggtgccgtatcctgtaatcgtccccttgcctgtgccagtccctattcccatccccatcccgatgcctcagagttctgaatccaagttcagctccagtttccccaagccaccatcttccttcggcctgcacccctttaaaggcacccagacccctctggaaaaagatgaactgaagccctttgacatcctccagcctaaggagtacttccagctcagccgccacacggtcattaagatgggaagtgagaacgaggccctggatctctccatgaagtcagtgccctggctcaaggctggtgaagtcagtcccccaatcttccaggaagatgcagccctagacctgtcagtggcagcccaccggaaatccgagcctccccctgagacactgtatgacagtggtgcatcagtggacagctcaggtcacacagtgatggagaaacttcccagtggcatggaaatttcttttgcccctgccacgtcccatgaggccccagccatgatggatagtcacatcagcagcagtgatgctgctaccgagatgctcagccagcccaaccaccccagcggcgaagtcaaggctgaaaataacattgagatggtgggcgagtcccaggcggccaaggtcattgtctctgtcgaagatgctgtgcctaccatattctgtggcaagatcaaaggcctctcaggggtgtccaccaaaaacttctccttcaaaagagaagactccgtgcttcagggctatgacatcaacagccaaggggaagagtccatgggaaatgcagagccccttaggaaacccatcaaaaaccggagcataaagttaaagaaagtgaactcccaggaaatacacatgctcccaatcaaaaaacaacggctggccaccttttttccaagaaagtaaataacggctttttaaaatttgtatgattataatatggggaaaggtgcattggttttataaaaaggcatttaaaacaaattatctttgttaattattttggggagtagttgggaaatggaaaggtgaattggctctagaggccctgtatgctagtatcattttcttttttaatttttgacttttcacaaatgagtaaataagagcaacctatttttcaagcagattgcacattttttgcagctttaatggaatattgggtgaattagaggggtaaaaaaagctattttcattgccacaaagtgctttgatgatgtaatacctaataaagggtaggatgaatatttcacaataaatgtttgtttgcact

SEQ ID NO: 26062 - DNA, 1952 bp, Homo sapiens
gaccctctcccgccgcggcctgggccagaagcacccggccctgcgctgcggaggcgatgccgcatcctagcactaagcccgggcagcggggaggggcagagagaacccaggggctgcgggaaacgtggaaaaggagtggccccatggggacccgggctcgctacagaccttcgccctgggggcggaggggaggggcccaccacggccttatttccgcgagcgccggcactgcccgctccgagcccgtgtctgtcgggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaataatgaaatgtgttgaatgttctcgtgaagatttgtatacaaaggaaaaatttgtgctaaactggaattaaatgaaatggtaatattgcttaacttaaattttacaaataatagaacgtctgtctcaccagataaagctgtctgcaaacatgcatcaaaagaaacactgatgtaactgaaagtatattaaatatttacaattttcatttacaaggacaa

SEQ ID NO: 26063 - DNA, 839 bp, Homo sapiens
gggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgcgaacttctaatttcatatcaagagttgtaatcacatttatttcaataaatatgtgagttcctgcaa

SEQ ID NO: 26064 - DNA, 740 bp, Homo sapiens
gccgccccgcgagaagaagagcgggaagaggcggacagcgaggccaagatttcagctgcgggacggtcaggggagacctccaggcgcagggaaggacggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagatgcgtggtgcctccaggaccgctgcgggtggtaaccagtggaagaccccagcccccagggagaggaacccgttctatccccagccatgataataaagctgctctcccagctgcctctc

SEQ ID NO: 26065 - DNA, 1618 bp, Homo sapiens
cggacagcgaggccaagatttcagctgcgggacggtcaggggagacctccaggcgcagggaaggacgtgaggaggggaagcgggctggggcggcagccgggcggaggggcagctgcgcaggcggaatgaggaacgcctttgctctaaggcgaccaccctggcagctcttcactgaggggcctcggtttccacatctgtcgctctccggtcccaagaccaccaggaccgacggggctctccgggagggtcagcccctccggtggccccagtcatgcatcaggggacggatcagaagggctaggaagaggggtcgtggggaaggccccagaaaaaagaggaaggagggaagattttgcctgaagcgggaaagccaagggctgggcggcgcgagacccccattcctagcgactggggctggctggtggcccgcggcagcccccgcgccgggaggattaggcctcccgccgctcccacccgtccggaccctcccacgtgtttaggtcctcccaaaagtattcggcctccggcccctgccccttcccccggctggcctggacctcggggacgtggggggaaccccgtgggagcagggggattctggacggggagggagtagcggttggggagaaggctgagcggggaaaggagagaggggctccggggacggcagggaggagagtgggtcgtgccggagacccagggagagacacaatgggcaagattaggggtgtagggtgggagtgcgaactgactgattcctagcgtgggcagggaactttgctaaaactgcaggccccagggaacagcgcgggcagggtgggagggaacggagagggccaggcggaccctaaggtcaatttggagaaagggccatttccaggctccttcacctgtgcccagcgttctacaggcctggaccccgcccccgctccccaccctccccccagagcagggcgcgggaggaggcggctcgggctggctcggagagctgaggggcgcacacccgcttcgcagggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaagccagcactgagatgcgtggtgcctccaggaccgctgcgggtggtaaccagtggaagaccccagcccccagggagaggaacccgttctatcc

SEQ ID NO: 26066 - DNA, 563 bp, Homo sapiens
agaagagcgggaagaggcggacagcgaggccaagatttcagctgcgggacgggccagggtgacacggaagcatgcgacggctgctgatccctctggccctgtggctgggtgcggtgggcgtgggcgtcgccgagctcacggaagcccagcgccggggcctgcaggtggccctggaggaatttcacaagcacccgcccgtgcagtgggccttccaggagaccagtgtggagagcgccgtggacacgcccttcccagctggaatatttgtgaggctggaatttaagctgcagcagacaagctgccggaagagggactggaagaaacccgagtgcaaagtcaggcccaatgggaggaaacggaaatgcctggcctgcatcaaactgggctctgaggacaaagttctgggccggttggtccactgccccatagagacccaagttctgcgggaggctgaggagcaccaggagacccagtgcctcagggtgcagcgggctggtgaggacccccacagcttctacttccctggacagttcgccttctccaaggccctgccccgcagctaa

SEQ ID NO: 26067 - DNA, 749 bp, Homo sapiens
agctgatccacaaacaagaggagcaccagacctcctcttggcttcgagatggcttcgccacaccaagagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttcagaaa

SEQ ID NO: 26068 - DNA, 696 bp, Homo sapiens
atggggctgcctgaaccaaagcccaaacctggagacctgattgagattttccgccttggctatgagcactgggccctgtatataggagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagttggtgtggccacggcgcttggaatcctggttgttgctggatgctcttttgcgattaggagataccaaaaaaaagcgacagcctgaagcagccacaaaatcctgtgttagaagcagctgtgggggtcccagtggagatgagcctcccccatgcctccagcagcctgaccctcgtgccctgtctcaggcgttctctagatcctttcctctgtttccctctctcgctggcaaaagtatgatctaattgaaacaagactgaaggatcaataaacagccatctgccccttc

SEQ ID NO: 26069 - DNA, 3271 bp, Homo sapiens
cagcctaacccagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattcta

SEQ ID NO: 26070 - DNA, 2780 bp, Homo sapiens
atgtacgagagtgtagaagtggggggtcccacccctaatcccttcctagtggtggatttttataaccagaaccgggcctgtttgctcccagagaaggggctccccgccccgggtccgtactccaccccgctccggactccgctttggaatggctcaaaccactccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagtgcgcaaagcgcaccaggaaaccttccctgccctctgccagctgggcaaatacactacgaacaacagctcagaacaacgtgtctctctggacattgacctctgggacaagttcagtgaactctccaaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctgccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 26071 - DNA, 2285 bp, Homo sapiens
agccgctgtactctgcctcggacgccacgagactctagacgggagtcccctcgaggtgaagccgctgagttcccgggccccgccaggcttccctgggagagccgacggaccccccctcccagcacacacaacttccctgcttttcaccgggactggcggagcggccggcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagatgtacgagagtgtagaagtggggggtcccacccctaatcccttcctagtggtggatttttataaccagaaccgggcctgtttgctcccagagaaggggctccccgccccgggtccgtactccaccccgctccggactccgctttggaatggctcaaaccactccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcac

SEQ ID NO: 26072 - DNA, 2008 bp, Homo sapiens
acatgatgtcacagacaatgacacaagccggtgtctcattccgacacagcgtccgagctgcacaatgtcacacccgggtgccaaacacttggccccgcgcgacccggccctacgcctcctgccgccgctctccgcgtctccgggggaggtggcccggttcggccgggcagggggctggcgggcgagccccgcgggcgggctggcgagcgggtgatgtcacgggcagcgccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcac

SEQ ID NO: 26073 - DNA, 3371 bp, Homo sapiens
agtctggggctccgggtaaagtttcagcctccgcacgtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 26074 - DNA, 1052 bp, Homo sapiens
tcagctccccagctaatgggccaagagattctccccgccaggtcccccactctcaggctggggagccctactccccacttgccccaggagctgctcagagccagtcccaagggacccccagggagactgcagctgggagggctggctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccac

SEQ ID NO: 26075 - DNA, 3104 bp, Homo sapiens
ctgctccgtaccctccgccccttcagtctggggctccgggtaaagtttcagcctccgcacgtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccactgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 26076 - DNA, 2074 bp, Homo sapiens
gagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcggcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccct

SEQ ID NO: 26077 - DNA, 1836 bp, Homo sapiens
ctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgcca

SEQ ID NO: 26078 - DNA, 2956 bp, Homo sapiens
tggggggggggtggggagggagaaaaagaaagaaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactc

SEQ ID NO: 26079 - DNA, 2959 bp, Homo sapiens
tggggggggggtggggagggagaaaaagaaagaaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagcagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactc

SEQ ID NO: 26080 - DNA, 1757 bp, Homo sapiens
catcatcaagatgagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactc

SEQ ID NO: 26081 - DNA, 1779 bp, Homo sapiens
caagccccaccccccacccctccaggcttcgcttttaaaaaaggtctccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccat

SEQ ID NO: 26082 - DNA, 1846 bp, Homo sapiens
cgcccgccgcccgctgcctgcgccgccggccgggcatgagttagtcgcagacatggacaccaaacatttcctgccgctcgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattc

SEQ ID NO: 26083 - DNA, 2421 bp, Homo sapiens
actagaccagcgagccctggagggctgggcagggccttgtcccctggtgcctcccggagcccagcacggggcagggccagctgggcacttagtttggacgagctctgtccctccaggggcttcactttcgccttctgcagcgtgggggatcatgtgtgaccttggccagcccctgacctccctgagccgcagcctctgcatctgggacacccagggtttcccatgcagggagtgtcaagtgtgggtgcaaagcccaggcaccgcacccctctgcagacgtctggggctttctcttgccccttcagttccctcccttctctgagaagcgcacctgctgcctgtggacatgaacactgggcatttggtgagtcacacagtggccacccgcttctccagtgggagcttcatggcacccccactgtgctgagttgtcacgggggacctcctggcctctcgcagcccacctgagtcctgcagggaccaagcatccttgtaaagcctcacagcccacctgggcagatcgaggaagaacctagaagccagaacaagctggggctggaagactcattccaggcaccgaggtccatgtgaaaggaggctttgcggtggtttctgctttgcttgcattgagcctcaaactcttcctgtcccgtgagaaggggggatgggatttggaggcctgaggaaggaaggaggggagcttcctgcgcacaagcggcggcaggggtttgcagaagtggaggctgggggctgcctggccaagcgcttaccgccctgcgcagccaggctggctggcaggctgcagcgggaagcgcctgtgggtcctcggcgctgactgcagagctgggtggaggcagcggaaccaaaactgctgtgtcactgcacgctgcagctgttgccagggtgaccggctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcag

SEQ ID NO: 26084 - DNA, 2908 bp, Homo sapiens
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26085 - DNA, 2846 bp, Homo sapiens
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26086 - DNA, 2832 bp, Homo sapiens
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaa

SEQ ID NO: 26087 - DNA, 2909 bp, Homo sapiens
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26088 - DNA, 1324 bp, Homo sapiens
acaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagcc

SEQ ID NO: 26089 - DNA, 2908 bp, Homo sapiens; identical to SEQ ID NO: 26084

SEQ ID NO: 26090 - DNA, 287 bp, Homo sapiens
gcagcccaaatgaccctgtgactaacatctgtcaggcagctgacaaacagctattcacgcttgttgagtgggcgaagaggatcccacacttttcctccttgcctctggatgatcaggtcatattgctgcgggcaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagat

SEQ ID NO: 26091 - DNA, 2908 bp, Homo sapiens
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26092 - DNA, 287 bp, Homo sapiens; identical to SEQ ID NO: 26090

SEQ ID NO: 26093 - DNA, 2846 bp, Homo sapiens
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26094 - DNA, 2894 bp, Homo sapiens
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaa

SEQ ID NO: 26095 - DNA, 2908 bp, Homo sapiens
ggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26096 - DNA, 287 bp, Homo sapiens; identical to SEQ ID NO: 26090

SEQ ID NO: 26097 - DNA, 287 bp, Homo sapiens; identical to SEQ ID NO: 26090

SEQ ID NO: 26098 - DNA, 2846 bp, Homo sapiens
gcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgga

SEQ ID NO: 26099 - DNA, 287 bp, Homo sapiens; identical to SEQ ID NO: 26090

SEQ ID NO: 26100 - DNA, 2846 bp, Homo sapiens; identical to SEQ ID NO: 26085

SEQ ID NO: 26101 - DNA, 2832 bp, Homo sapiens; identical to SEQ ID NO: 26086

SEQ ID NO: 26102 - DNA, 1227 bp, Homo sapiens
accttcgccctaatgcctttaccaatatggcggcactccggtagcgacgaatccatcctgcactgacacgcatgcgcgagtgtggaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgaga

SEQ ID NO: 26103 - DNA, 2869 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccggggctccttctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26104 - DNA, 2859 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccaggggggctcccagcatatctcaaaatctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26105 - DNA, 1227 bp, Homo sapiens
accttcgccctaatgcctttaccaatatggcggcactccggtagcgacgaatccatcctgcactgacacgcatgcgcgagtgtggaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcggtccctctccagggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgaga

SEQ ID NO: 26106 - DNA, 2868 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccggggctccttctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26107 - DNA, 2859 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccaggggggctcccagcatatctcaaaatctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26108 - DNA, 1324 bp, Homo sapiens; identical to SEQ ID NO: 26088

SEQ ID NO: 26109 - DNA, 2860 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccaggggggctcccagcatatctcaaaatctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgcccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26110 - DNA, 1324 bp, Homo sapiens; identical to SEQ ID NO: 26088

SEQ ID NO: 26111 - DNA, 2868 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccggggctccttctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggatctcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26112 - DNA, 1227 bp, Homo sapiens; identical to SEQ ID NO: 26102

SEQ ID NO: 26113 - DNA, 2869 bp, Homo sapiens; identical to SEQ ID NO: 26103

SEQ ID NO: 26114 - DNA, 2868 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccggggctccttctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26115 - DNA, 1324 bp, Homo sapiens; identical to SEQ ID NO: 26088

SEQ ID NO: 26116 - DNA, 2860 bp, Homo sapiens; identical to SEQ ID NO: 26109

SEQ ID NO: 26117 - DNA, 1227 bp, Homo sapiens; identical to SEQ ID NO: 26105

SEQ ID NO: 26118 - DNA, 2859 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccaggggggctcccagcatatctcaaaatctccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttttcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcggggtctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccccatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctgg

SEQ ID NO: 26119 - DNA, 1227 bp, Homo sapiens; identical to SEQ ID NO: 26105

SEQ ID NO: 26120 - DNA, 1324 bp, Homo sapiens; identical to SEQ ID NO: 26088

SEQ ID NO: 26121 - DNA, 2036 bp, Homo sapiens
gcggtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgagacttttataggtggacttttgtatagatgttaaaggtaatacgctttgctgtctacagggctgggagactttctggaagttcttgggaaaactaatcaagcctctgtacatacaattggtttaaattattttttcacttgccctggaaagcaaacaaatgagtaataaaataatatgtgtgaaattggca

SEQ ID NO: 26122 - DNA, 694 bp, Homo sapiens
ctgcagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaaccgcggctggaagcagtggattgagggggacaagctgtacctggagctgacctgtggtgaccaggtgtgccgtcaagtgttcaaaaagaaatgatggcgacgtgggaggcctgccaagcacaagctccccactgcccacactgagtggtctactggctttgagaaacagctgtggggaccttcccactcttgacagagccccattaaggcatctgggtgggttttaaacagaatgcctatgtagcagtgatagacatattcccctcctttgaaacctagcattaaatggaaaaacaaaaattactcccatattttgaaacccttta

SEQ ID NO: 26123 - DNA, 180 bp, Homo sapiens
tagggagccagcccaggagcccagctgctgcagtcagatgctcccaaggacagcagcctgctccttgccatccaccacaaaccctcaccgaaccagtggccaccaccatgacaagggaccagaatggaacctgggagatggagagtaatgaaaactttgagggctacatgaaggccctgg

SEQ ID NO: 26124 - DNA, 489 bp, Homo sapiens
ctgctgcagtcagatgctcccaaggacagcagtctccagaaagcttcttgtaacctggaaagattggttatagttgatcattttcctccatcttaaaagtcacctgaagaattccacaaggacttagcctgctccttgccatccaccacaaaccctcaccgaaccagtggccaccaccatgacaagggaccagaatggaacctgggagatggagagtaatgaaaactttgagggctacatgaaggccctggatattgattttgccacccgcaagattgcagtacgtctcactcagacgaaggttattgatcaagatggtgataacttcaagacaaaaaccactagcacattccgcaactatgatgtggatttcactgttggagtagagtttgacgagtacacaaagagcctggataaccggcatgttaaggcactggtcacctgggaaggtgatgtccttgtgtgtgtgcaaaagggggagaaggagaa

SEQ ID NO: 26125 - DNA, 4276 bp, Homo sapiens
tgtccaccagctgagaaggacaagggcggaaggcagctgcacagagcagggccacggccttgcacacagtccagggagcttttgtgcaggagccaggcctccccctgggtccccatgatgagagaatgggttctgctcatgtccgtgctgctctgtggcctggctggccccacacacctgttccagccaagcctggtgctggacatggccaaggtcctcttggataactactgcttcccggagaacctgctgggcatgcaggaagccatccagcaggccatcaagagccatgagattctgagcatctcagacccgcagacgctggccagtgtgctgacagccggggtgcagagctccctgaacgatcctcgcctggtcatctcctatgagcccagcacccccgagcctcccccacaagtcccagcactcaccagcctctcagaagaggaactgcttgcctggctgcaaaggggcctccgccatgaggttctggagggtaatgtgggctacctgcgggtggacagcgtcccgggccaggaggtgctgagcatgatgggggagttcctggtggcccacgtgtgggggaatctcatgggcacctccgccttagtgctggatctccggcactgcacaggaggccaggtctctggcattccctacatcatctcctacctgcacccagggaacaccatcctgcacgtggacactatctacaaccgcccctccaacaccaccacggagatctggaccttgccccaggtcctgggagaaaggtacggtgccgacaaggatgtggtggtcctcaccagcagccagaccaggggcgtggccgaggacatcgcgcacatccttaagcagatgcgcagggccatcgtggtgggcgagcggactgggggaggggccctggacctccggaagctgaggataggcgagtctgacttcttcttcacggtgcccgtgtccaggtccctggggccccttggtggaggcagccagacgtgggagggcagcggggtgctgccctgtgtggggactccggccgagcaggccctggagaaagccctggccatcctcactctgcgcagcgcccttccaggggtagtccactgcctccaggaggtcctgaaggactactacacgctggtggaccgtgtgcccaccctgctgcagcacttggccagcatggacttctccacggtggtctccgaggaagatctggtcaccaagctcaatgccggcctgcaggctgcgtctgaggatcccaggctcctggtgcgagccatcgggcccacagaaactccttcttggcccgcgcccgacgctgcagccgaagactcaccaggggtggccccagagttgcctgaggacgaggctatccggcaagcactggtggactctgtgttccaggtgtcggtgctgccaggcaatgtgggctacctgcgcttcgatagttttgctgacgcctccgtcctgggtgtgttggccccatatgtcctgcgccaggtgtgggagccgctacaggacacggagcacctcatcatggacctgcgccacaaccctggagggccatcctctgctgtgcccctgctcctgtcctacttccagggccctgaggccggccccgtgcacctcttcaccacctatgatcgccgcaccaacatcacgcaggagcacttcagccacatggagctcccgggcccacgctacagcacccaacgtggggtgtatctgctcaccagccaccgcaccgccacggccgcggaggagttcgccttccttatgcagtcgctgggctgggccacactggtaggtgagatcaccgcgggcaacctgctgcacacccgcacggtgccgctgctggacacacccgaaggcagcctcgcgctcaccgtgccggtcctcaccttcatcgacaatcacggcgaggcctggctgggtggtggagtggtgcccgatgccatcgtgctggccgaggaggccctggacaaagcccaggaagtgctggagttccaccaaagcctgggggccttggtggagggcacagggcacctgctggaggcccactatgctcggccagaggtcgtggggcagaccagtgccctcctgcgggccaagctggcccagggcgcctaccgcacagctgtggacttggagtctctggcctctcagctcacagcagacctccaggaggtgtctggggaccaccgcttgctagtgttccacagccctggcgagctggtggtagaggaagcacccccaccaccccctgctgtcccctctccagaggagctcacctaccttattgaggccctgttcaagacagaggtgctgcccggccagctgggctacctgcgttttgacgccatggctgaactggagacagtgaaggccgtggggccacagctggtgcggctggtatggcaacagctggtggacacggctgcgctggtgatcgacctgcgctacaaccctggcagctactccacggccatcccgctgctctgctcctacttctttgaggcagagccccgccagcacctgtattctgtctttgacagggccacctcaaaagtcacggaggtgtggaccttgccccaggtcgccggccagcgctacggctcacacaaggacctctacatcctgatgagccacaccagtggctctgcggccgaggcctttgcacacaccatgcaggacctgcagcgggccacggtcattggggagcccacggccggaggcgcactctctgtgggcatctaccaggtgggcagcagccccttatatgcatccatgcccacccagatggccatgagtgccaccacaggcaaggcctgggacctggctggtgtggagcccgacatcactgtgcccatgagcgaagccctttccatagcccaggacatagtggctctgcgtgccaaggtgcccacggtgctgcagacggccgggaagctggtggctgataactatgcctctgccgagctgggggccaagatggccaccaaactgagcggtctgcagagccgctactccagggtgacctcagaagtggccctagccgagatcctgggggctgacctgcagatgctctccggagacccacacctgaaggcagcccatatccctgagaatgccaaggaccgcattcctggaattgtgcccatgcagatcccttcccctgaagtatttgaagagctgatcaagttttccttccacactaacgtgcttgaggacaacattggctacttgaggtttgacatgtttggggacggtgagctgctcacccaggtctccaggctgctggtggagcacatctggaagaagatcatgcacacggatgccatgatcatcgacatgaggttcaacatcggtggccccacatcctccattcccatcttgtgctcctacttctttgatgaaggccctccagttctgctggacaagatctacagccggcctgatgactctgtcagtgaactctggacacacgcccaggttgtaggtgaacgctatggctccaagaagagcatggtcattctgaccagcagtgtgacggccggcaccgcggaggagttcacctatatcatgaagaggctgggccgggccctggtcattggggaggtgaccagtgggggctgccagccaccacagacctaccacgtggatgacaccaacctctacctcactatccccacggcccgttctgtgggggcctcggatggcagctcctgggaaggggtgggggtgacaccccatgtggttgtccctgcagaagaggctctcgccagggccaaggagatgctccagcacaaccagctgagggtgaagcggagcccaggcctgcaggaccacctgtagggaagggccccataggcagagccccagggcagacagaacctctgggacacacaccaagggcactcctgcaggtggcccggcctgaggttcccaggagcagcaaaggggcctgctgagctctggttaggttacagctggaggtgtgtatatatacacacacacacatgtatatacacatatatatgtgtatgtatatatatgtatatatatatggctttccaataaccacctaaattttaacaaaggttccttctaagtggtagaacttggggtggtatttttaccttccttcttcatactttgctctttttcttaaatactcattaatgtgcatatatcattattttcagatgcagctatcattattccaaaatacaaaataaagaagataaaataaattatatacccgagccattaa

SEQ ID NO: 26126 - DNA, 838 bp, Homo sapiens
atgaattattccaaaattcctgcacaagtggacctcagaaggcagacggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtg

SEQ ID NO: 26127 - DNA, 1068 bp, Homo sapiens
gctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctg

SEQ ID NO: 26128 - DNA, 1314 bp, Homo sapiens
gccaatttggcatggccagggcctgggcactcacgcaccagggagcctcgcgggtccgctctcgctctgtgaggccacggtcttcccgccaggttgactcgagcctcctgccagagccactggccccggaggccaccctagaccgcagctggcggccgctggcacgagtgcagggtaactgagccagggccgctggcgcatttggcctggccgaggccaccccgcgcggccgctccactgtgcccgaggctgtcctggaggtgaggccggcccacagggaccctgcccgtgcccgggctccgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctg

SEQ ID NO: 26129 - DNA, 1016 bp, Homo sapiens
atcctttataaaatgaaaaactacttggatgaattattccaaaattcctgcacaagtggacctcagaaggcaggcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctg

SEQ ID NO: 26130 - DNA, 1012 bp, Homo sapiens
ttattgcaacagggccccagccttataaaaagccctggtaacccggccattacacatcctgtctctgtgtgtggagctggctggaatctctcagcctcacctgccagacaacaccccctccttcctcaccctgtctcctgcattctcctgaaaccttcatccacacaatgcctcccaacctcactggctactaccgctttgtctcgcagaagaacatggaggactacctgcaagccctaaacatcagcttggctgtgcggaagatcgcgctgctgctgaagccggacaaggagatcgaacaccagggcaaccacatgacggtgaggacgctcagcaccttccgaaactacactgtgcagtttgatgtgggagtggagtttgaggaggacctcaggagcgtggacggacgaaaatgccagaccatagtaacctgggaggaggagcacctggtgtgtgtgcagaaaggggaggtccccaaccggggctggagacactggctggagggagagatgctgtatctggaactgactgcaagggatgcagtgtgcgagcaggtcttcaggaaggtcagatagccggagaggagccaagatccctccagacagcaccagctcacagacgctcttgttgtgcccccttcaagcccagattgtgccaggtcagctgtcccttcctctggccacctttcctccctctgggtccctcctcacccctccccgtgttaatctgtaacttgcagcccccaggccaaagtcctttctcacactccactgcccaatagtgacctcacttccaggtcaaggtctggcgtcccaaatgaaagaagcaggcaaagggaaggagcccctgagaacaaccaatctccgctctctcctgtccatttgacctcttcttttccttctaagaaagaactaagctttgggcatttggcgattagtgaaaattctatcctgatggacttctggaaaactgtgactggggttcaagagtttaaacaggggctactggcaga

SEQ ID NO: 26131 - DNA, 3949 bp, Homo sapiens
cggagcgctctgacttgcaagcgggctgcgctgcggagcccagtgcccgagtgacacccgcggagagtgcagggccggggaacgcgagccctcgggggcagctgcaaggcgttgggcagcgcttgcctgcgccgagcgagtctccccttcccggcgctccgccgccccgcaccccactctcccaccctctcgcaacttgggtcgagttgacaactcccgcggcagcccgctggcccgtgccgcctccgctgcgcacccctcccccggggtgagagggagccggcgcgccggttccggggacgctcgggcggcagcagcttggccatgagggcagttcgagtagtctaactcgcggctgtcaccgccactgcagcggagccggccggccgggcgctgcgggacgggcgggcggctgccggcaggaggcgccgagccgggtgactgccgcggcgggcacagtccggggccacagcgccgagcccgggcgggagtggccccgcgcaggcagggagcggcgccgcgcactccaacccggcgggcacctcgggggcgggcgcggggcgcagccttctcgtcccggcctctgtgacaagcgccccggagccgggagcccgattgccgggctcggggtgggcgcggacgcaggcactgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgtttgtatgtttagctcttttgaaaaggaattttgaaatctccatcaactgaagtaaatgatgtctgagtgttacagtaaaggtgaccaagtctctttcttaaagtcacaatgactaaagtattagttgaatttttttttttttttttttgatggagtctcgctctgtcaccaggctggagtgcagtagcacaatcacggctcactgcaatctctgcctcccagtttcaagtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaaggaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaa

SEQ ID NO: 26132 - DNA, 2588 bp, Homo sapiens
gtctgctccccgggctgtcgcaatttgaattggggcgtgtctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtcaaa

SEQ ID NO: 26133 - DNA, 1926 bp, Homo sapiens
cggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaa

SEQ ID NO: 26134 - DNA, 1833 bp, Homo sapiens
ctccagaggactgtatgctgttcttaaggactctctgcttcctggacaagctcaagctaaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctc

SEQ ID NO: 26135 - DNA, 1723 bp, Homo sapiens
ggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctc

SEQ ID NO: 26136 - DNA, 1879 bp, Homo sapiens
gggcacaagcaatcctcccttctcagcttcctgagtggccaggactacagaggactgtatgctgttcttaaggactctctgcttcctggacaagctcaagctaaggactacatctcccagcaggctgtgctctgacagctcttggatttaaataggattctgggctctgctcagagtcaggctgctgctcagcacccaggacggagaggagcagagaagcagcagaagcagccaagagctggagccagaccaggaacctgagccagagctggggttgaagctggagcagcagcaaaagcaacagcagctacagaagttggaacgatgctggtcaccttgggactgctcacctccttcttctcgttcctgtatatggtagctccatccatcaggaagttctttgctggtggagtgtgtagaacaaatgtgcagcttcctggcaaggtagtggtgatcactggcgccaacacgggcattggcaaggagacggccagagagctcgctagccgaggagcccgagtctatattgcctgcagagatgtactgaagggggagtctgctgccagtgaaatccgagtggatacaaagaactcccaggtgctggtgcggaaattggacctatccgacaccaaatctatccgagcctttgctgagggctttctggcagaggaaaagcagctccatattctgatcaacaatgcgggagtaatgatgtgtccatattccaagacagctgatggctttgaaacccacctgggagtcaaccacctgggccacttcctcctcacctacctgctcctggagcggctaaaggtgtctgcccctgcacgggtggttaatgtgtcctcggtggctcaccacattggcaagattcccttccacgacctccagagcgagaagcgctacagcaggggttttgcctattgccacagcaagctggccaatgtgctttttactcgtgagctggccaagaggctccaaggcaccggggtcaccacctacgcagtgcacccaggcgtcgtccgctctgagctggtccggcactcctccctgctctgcctgctctggcggctcttctccccctttgtcaagacggcacgggagggggcgcagaccagcctgcactgcgccctggctgagggcctggagcccctgagtggcaagtacttcagtgactgcaagaggacctgggtgtctccaagggcccgaaataacaaaacagctgagcgcctatggaatgtcagctgtgagcttctaggaatccggtgggagtagctggtggaagagctgcagctttatcaggcccaatccatgccataatgaacagggaccaaggagaaggccaaccctaaaggattgtcctcttggccagctggtgctgcgaatcctgcctgctctgatcctcttgacccttctgggaatgtttgcacacctgacactcttgtgagactggcttatggcatgagttgtggacacctatagagtgttcttctctaagacctggaaagtcagcaaccctctgggggcagcaggactgggcagatcccaggctgggcatgggggtggcagaagagcccgagaaattgggtcagttccctcatcagcaccagaggctcagctgaggcaagaagagcaccatcactgcctatttctaggggctatacactccaactcttggttgatctctttctttttaaaaatatttgccaccaccctggagtctagaccaacacacaaagatcctggctaaccctggcctatttagattccttcctctcacctggaccttcccatttcaatcatgcagatggtttctttttgtaaagagttccgtttgcctttcaatttttagagaaaataaagactgcattcatctcat

SEQ ID NO: 26137 - DNA, 1269 bp, Homo sapiens
ggactttggccttagcagtagttagtgtgggaggctgggaagactgggagcagtctcttaaacaaaagcaaaagaataagcttcgggcgctgtagtacctgccagctttcgccacaggaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaa

SEQ ID NO: 26138 - DNA, 1259 bp, Homo sapiens
cagtagttagtgtgggaggctgggaagactgggagcagtctcttaaacaaaagcaaaagaataagcttcgggcgctgtagtacctgccagctttcgccacaggagcctaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaa

SEQ ID NO: 26139 - DNA, 1714 bp, Homo sapiens
tgtctatagtaggtgcggagaagaaatgtttggcagatgaagaaaatgaggtgcagagaggatttaagagattctctcttactgcctgttcagggtcagtccagaattgagggtctccgggggagggcagaggctttgccctgcaggggatctgtgggagggggttaggagggagcagatgagcccaggatgaatggtcagagtcaggtgctgcccggcggaggtcacgagtccagggaggggatcaacatggccgctgcaccccggactgtgttgatctccggctgctcatcaggaattggtctggaacttgcagtgcaactggcccatgaccccaagaagcgctaccaggtcgtggccaccatgagggacctggggaagaaggagacactggaggcagctgctggggaggctctggggcagaccctcaccgtggcccagctggacgtgtgcagtgatgagtcggtggcccagtgtctcagctgtatccagggagaagtggacgtgctggtgaataatgctggaatgggcctggtggggcccctggaggggctcagccttgctgccatgcagaatgtctttgacaccaactttttcggagctgtccgtctcgtcaaagctgtgcttccaggcatgaagaggaggcggcagggccacatcgtggtgatcagcagtgtcatgggcctgcagggtgtcatcttcaacgatgtctatgcagcttccaagttcgccctggagggattcttcgaaagcctcgctatccagctgctgcagttcaacatcttcatctccctggtggagccaggccccgtggtcaccgagtttgaggggaagcttctggcgcaggtttctatggctgagttcccaggcactgaccctgagaccctgcactacttccgggacctctatctcccagcctccaggaagctgttttgctccgtgggacagaacccacaggacgtggttcaggccattgtcaacgtcatcagctcgactcgaccacccctgcgccgacagaccaacatccgctactcgccgctgaccacgctcaaaaccgtggattcctctggcagcctgtatgtgcgaacgacccaccgcctcctcttccgctgtccacgcctcctcaaccttggccttcaatgtctgtcctgcggctgcctcccaacgcgggtgcggccaagatgagcagaacagagcttcacgatccccatccctgaacaaccagacctcttcattccacatctaattcaaaggatgaacagactcttcatttattcattctgcaaactccccctcccctcctctgtgcctagacatggctagaatcccagaagggcctttattttcaggcatagactcctctgtggtcacagctggagcacagagagggaccctgggaacttggcctgggaagcccagagcaggaagccacagctgtctctgggaaagcaagggaggcttcctggaggaagcggcattgttatgagccttgaaggaagagacagactctgctacattcaacctcgtgacttcatgatcctgggcctgagaacacaggaatgattcatagcccaccccccacctccatgcatacaccagagctctgtggaccaaggggtcattcctggtcacacactccatcagcaaaatgtatttgagcacacaccagcaatgtatgtatattttttccattaaatatatatttataaccaca

SEQ ID NO: 26140 - DNA, 2810 bp, Homo sapiens
cagttcagtaaggtagagctttggccgaggacgaggggaagatgtcacgcaagatagaaggctttttgttattacttctctttggctatgaagccacattgggattatcgtctaccgaggatgaaggcgaggacccctggtaccaaaaagcatgcaagtgcgattgccaaggaggacccaatgctctgtggtctgcaggtgccacctccttggactgtataccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtgtacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggta

SEQ ID NO: 26141 - DNA, 4193 bp, Homo sapiens
gactggacgccatcacaaccttaccaatcttcagaatacactcctttccatccgacgaaatgatagaaccctctgaagactcatttgagacgatgatggagcataagaatccatcatcaaaacaaatggagtcctccgagggctcatccaacaccaccgaggcgacgtcgggcagtggagtgcggggagaggcagggccagccagcggcccagcccaggaaaagaaggagccccccagtggcccactccaggaaatggaagagctgcccactgatctactccaagacatggaggagccatccagtggcccacgtaaggaaatagaggatccacccaatgacctactccaagacctggaggagtcatgcaacggttcacaccaggcaaggggggatccactcagtggagcatctgataggatgaaagaagcatcagtcaacccatcgggagcccgagaagaacaagaggctcacactgacctgaaggaatcgggaagggaggagactcctcaagagcaaaaccagaccgagcactcaaccgcagaacttatggccatggtgaggtccatcatctcgctgtacttccgaatgcaagacctcaaagagcaacagagagtagcagaagagatcttgatcaaagggatcaatgcaggccaactgcccgccccaaagcacttctctggcgatcgcagagaattccacgagttcatcgtactctgccaactgaccttacagagctacccaagaatgttctataacgaccgtctgagagttggctatgtcatcaatcacctgtccggcttggcattagaatgggccaaagctctactgcaggaaaacagccccctgatcggagacttcccagccttcctggaggccatgtccgaagtgtttgagtaccgccaggcactgcgtgtggcagaagaggccatgttcaccatcaggcagggcggccgctctgccactgagtacatcgatgagttccagagcctggtacccatcttgggctggccagatgaagtcctgcaggcccacttgtgccaggggctcaacgaggagatcaggcactatctattccgggtccctcagccggattccctagacagtctgattgtgctcatcctgcaaatagaagagaagctggcagagagaagagctatgctcaggctgccccccgaggcccgcccccggaacctgacctggatcgactcacctgctccagagaggtggatggtcagcagctggttgcccagcgaagtccatccggacatcaatcgcgcccacctcttcctgctgctcatggtgagagtgaacccctaccacagcgtcgcggtccaggccctggtggattcgggagctgacggcaacttcatggatgagaagttcgcccaagagcactacgtcgagctctacgagaagccgtacccacagccggtccaatccgtggacggctcgctgattggcaacgagcctgtctggctctacacggagcccctggtgtgtatccaccagaaccaccaggagtccatcgaatttgacatcgtaccttcaccgaacttctctgtggtcctaggcatccgctggctccgagtccacgcccccgaagtcgactggatcaaaggccgctgcaccttccactctccctactgcctgaagaactgcttccgcccgcccccgccatgcattgccctagagaggcacggcatgagcctgctacccggactgccacacccatactcagacctggccgacgtgtttaacccgaaggaagcagatgatgagacttccgaccagccaagctcagacggatccgatgatctttctgaatcagagccctctgagcttcagcaggctggagacagtgatcacagcgagaccttttacgagtgtccctccaccgcgccttgggaacctgtgggtgccaggatgcaagaaagagccaggctacaggaggaatactgggacctgcaggacatgctgaccaacagacaggactacatacagatgattccggaactgtttgaccagttacacggagccgagtggttcacaaaactggagctgcgtgggaccattgtggaggaaagcgtgaacgggcaccgcaccgaagatgtgtggaaagcagcgtttggtttggagcttgaagagatgaagagctaccagccgtttgcgctctccccagaccctatcatacctcagaacgtgattcacttcatcctaaaggacatgctagggttctttgtgctttcttatggccaggaagtcctgatctactcaatgagtcaggaggagcacctccaccacgtccgccaagtcctggtccgcttccgccatcacaacgtctactgctccctggacaagagccagttccaccgccaaaccgtggaattcctgggcttcgtcgtcacccccaaaggggtgaaactgaacaagaacgtcatgaccatcataacagggtaccctacccctggctccaagctatctctgcgaaacttcatcgaattcgtcttcccctaccgccacttcgtggagcgcttcagcatcatcgcagagcccctggtgcggcagctgctgagctcctaccagttctactggggagtcgaggagcaagaggccttcgagtgcctgaagagggctttccgcaaggcgcctctcctccaccaccccaagccccagaacccattctacttggaaaccggcgtcaccggcacggccctgcacgcctccctgatccaaatcgacgaccaaaccggcaagagagcctgctgcgctttctactcccgcaacatctcccctatcgaggttgagtactctcaagcggagatgaagattcttccaatacgggctgccttcatggtgtggtgccgctacctggagaacaccgaggagcccatcatgatccttctcaacacagaggatctagcctctctgaataatgacaggctcaccgtacttctccccgggcattgggtcttcttcttctcccacttcaactttgacgtcatggagctgccagaacaagacggcggccgagctctgccacctgtgagaaacctccggtggaggagagccttccagaggaacactgccgccaggcaaaccctgctgctggcctcaaggggattccccagggatccatcgacggaatccggggaagaagagaatgaagaacaggatgagctcaatgaacagatcctacggcaagagctgctggccatgatacccatcgaccagatcctcaacagcttcctcgcccacttcagcatggcccagatcagggccgtcattctgcacttcttccgaggcctcctgtactggaagaacaccctagccctggcagccatcctcgtgctactgcgcgtgaggcaatgcctctcgctgcggccggcacccgccatgcgggtggctcggccccagccccagcgctccctacgactcatcctggattcgtccctcatcgcaggcagcagcatcacgacagccatcacccagctgctcacccagatgcccgctctcgtaggtgcaaacaccatcccagcccaggagctggctgagctgttcctgggccctggccgctggcagcgaaatgctctgcactcccaggcccaccgaggcctgcagttcacccctggcttctggctgacgctgtgtgagttcttcggtgtcagagtcaccccccaggagggccacctccctgccctgcgtcagaaccgctacctggagctgcacgtcgttggtgatgaggatgtcgtcttgcgagaagccctgcaagacgacctgcaacgttaccgtcagtgtggcctgcatgacggcctgcaagacacctcgcaggacaagcaggacaacgacgtgcaggaggccccacccagccacacagcagccacccacccaccccgcccacgccacctgatggatccccaggtcctggaattccttggtagccgcctgctccacatccacagtgcagatggccagctgcacctgctcagccgggagcaggcagccagggccctgagccagttcctgaccctgatctacaggcgggccctgcccatccccgcctgggagagccagcccagggagcaggcaaggctagaagagctgcctgatgaggacgaagatgctaacctcgactgaagacgcctccctgtctccagcaaagagtcccctctatttctcaccccaacacctccc

SEQ ID NO: 26142 - DNA, 10789 bp, Homo sapiens
cgagatctgcgcctcgcctccctcctcacgcgggcggattttcttaccttgtgaaaaaccgtctcagcggctgcccccgcctcctctgctggatgtgaaatggcggtcggcgagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaa

SEQ ID NO: 26143 - DNA, 10701 bp, Homo sapiens
catcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatata

SEQ ID NO: 26144 - DNA, 10461 bp, Homo sapiens
tggttgcgtccgtgacatcatcatcatggcaacaagagctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaataatggaaaccatattaaaattgaataaaatataaaataatata

SEQ ID NO: 26145 - DNA, 10917 bp, Homo sapiens
cgagatctgcgcctcgcctccctcctcacgcgggcggattttcttaccttgtgaaaaaccgtctcagcggctgcccccgcctcctctgctggatgtgaaatggcggtcggcgagtggttgcgtccgtgacatcatcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcagaataaaacccaagacaagccacataaaagcaacctaaaaattaaactgtcatcatattatttgttttaaaactatggaataatatatctgaggaagatttctctcaaaattgtttttctcaatttcaagtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagccttcagtaagaaaaggtgtactaccaagaatgcttgaagaaattttgaagactagatttatggtgaagcagtcaatgaaggcttacaagcaagacagagccctgtcacgaatgcttgatgcgcgtcagttgggacttaagctgatagcaaatgtcacatttggctatacatctgctaatttttctgggagaatgccatgcattgaggttggcgatagtattgttcacaaagccagagagaccttggaacgagctattaaactggtgaatgataccaagaaatggggggctagggttgtatatggcgatactgacagtatgtttgtgctactgaaaggagccactaaggagcagtcttttaagattggtcaggaaattgccgaagctgtaactgctaccaatcctaaaccagtgaaattgaagtttgaaaaggtatatttgccctgtgttttacaaacaaaaaagaggtatgtgggttacatgtatgaaacactggatcagaaggacccagtatttgatgcaaaaggaatagaaacagtcagaagagattcctgccctgctgtttctaagatacttgagcgttctctaaagctgctatttgaaacgagagatataagtctaattaaacagtatgttcagcgacaatgtatgaagcttctggaaggaaaggccagcatacaagactttatctttgccaaggaatacagaggaagtttttcttataaaccaggagcttgtgtgccagcccttgaacttacaaggaaaatgctgacttatgaccggcgctctgagcctcaggttggggagcgagtgccatacgtcatcatttatgggacccccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaaggatccataaagctaccagctcctcgcgaagtgaacctgaagggcggaaaggcactatttcacaatattttactaccttacactgtcctgtgtgtgatgacctaactcagcatggcatctgtagtaaatgtcggagccaacctcagcatgttgcagtcatcctcaaccaagaaatccgggagttggaacgtcaacaggagcaacttgtaaagatatgcaagaactgtacaggttgctttgatcgacacatcccatgtgtttctctgaactgcccagtacttttcaaactctcccgagtaaatagagaattgtccaaggcaccatatctccggcagttattagaccagttttaaattgtcaatatcacagtattacaggtgctatttttttcagtgcttaccactaaactgttgtgcatggtgctttttaactttcatcgagtcaaggatgttcactgtctgttatctgaagactatgaagacttctatgctaaccgaattaaaatgtacttgttgatctctgaatagctcacttcttacaatgtacaaattcctcattctgtcaccttttaaacattgttttataatgcaggtgttggatttgctccagtatgtgtaccatcttgtaaattcatttgagtagatcatgtttacttcccagtggaaggagcactgaaaacctcttaaagaaaaagcatttgtgtgttttccttgaactgtctgtatcaagacgtgttacttcgagatatccattcactttataattttgactgcaaaatattttgtaaatacacttttttacttttcaaacgagcaaaataatgtgcaatgatttttatacaaatgattttcaagttgtttggtatatttcctctaggttttgcttgactcaaagtagatcgttattttgatcaaactgtgcaaacagtagtaccacgtgtagcattttgaaacattatttttttttaaaaaatgctgtcttgctttagctattaatggggcattgtgaggaactgtgcaaagacatttttgttacaaacctgtgggcctgttgcaatactttaaaaataaaaaattttattccatttgcttgttttgtatagacatttctattgcttctaaatatacttaaaatattttctttccttatgtactgtacagttaatcttatttgccatcatcttgaacacaaaatgtgtatttagaatatttgtataactgtgtaaaataaaaaaggaattatgtggtcagtgcattgttttttaaactggaaatcattttgttttaaaagttaa

SEQ ID NO: 26146 - DNA, 8393 bp, Homo sapiens
catcatcatggcaacaagagctgcagcctgggaccgaggagcccgtgtgattcccggcggtggcggcagtggcggcagcaccagcaccgacgaaagctcgagggcttctctcctgcggccccttgccgggtgctcctgaggaggcggcggcagcagcgcctacaccgccccgcccgccgctcctcgaggtgcctctgtgtgaggggagggggccgtgccgagaaggggagggggcgccgccgccgctgcggagggagccgccgccgctgctgctgccgctgccgggtcgccagtgaagggaggcagtggcggcggcggcgaacatgttttcagtaaggatagtgactgcagactactacatggccagcccgctgcaggggctggatacctgccaatcccccctcacccaggcccctgtcaagaaggtgccggtggtgcgagtcttcggagcgaccccggcaggtcagaagacatgtcttcatctacatggcatctttccttacctctatgtgccatacgatggttatggacagcagccagaaagctatctttctcagatggcattcagtatcgacagagcacttaatgtggctttaggcaatccatcttccactgctcagcatgtgttcaaagtgtcattagtatcaggaatgcctttttatggttatcatgagaaggaaagacactttatgaagatctatctttacaatcctacaatggtgaaaaggatatgtgaacttttgcaaagcggagccataatgaataaattttaccagcctcatgaagcgcatattccctacctcctacagctcttcattgactacaatctttatggcatgaatttaataaatctggctgctgtcaagttccgaaaagcaagaaggaaaagtaatacattgcatgcaactggatcctgcaagaatcatttatcaggaaattctcttgctgatactttatttcggtgggaacaagatgaaataccaagctctttaatattggaaggtgttgaaccacagagtacatgtgaattagaagtggatgctgtagctgctgatatcttaaatcgtctggacattgaagctcaaattggtggaaaccctggtctacaggccatatgggaagatgaaaagcaacggcgaagaaacagaaatgaaacttctcaaatgagccaacctgagtcacaagatcacaggtttgtgccagcaacagaaagtgaaaaaaaatttcagaagagacttcaggaaattctcaaacagaatgatttctctgtaacattatcaggatctgtggactacagcgatggatcccaggagttctctgctgagttaacattgcactctgaggttctgtctcctgaaatgcttcagtgtacaccagccaatatggtagaagttcacaaagacaaagagtcaagcaaaggtcacactagacacaaagtggaagaagctcttattaatgaagaagcaattttgaaccttatggaaaatagtcagacttttcagcctttgacccaaagactgagtgagtcacctgttttcatggacagtagtcctgatgaggctctggtacatcttcttgctggtttggaaagtgatggatatcggggggaaagaaataggatgccatcaccatgtcgctcctttggaaataataaatatccacaaaatagtgatgatgaagaaaatgaaccacagattgaaaaagaggaaatggagcttagtttggtgatgtcccagagatgggacagcaatattgaagaacattgtgccaaaaagagatcactgtgcagaaatacccacagaagttcaactgaagatgatgactcatcttcaggagaagaaatggaatggagtgataacagtttgcttctagccagtctttctatacctcagttagatggaactgcagatgaaaatagtgacaatccattgaacaatgaaaattctagaacccactcttctgtaattgcaacaagcaagctttcagttaaaccctccatctttcacaaagatgctgctacattagaaccctcatcttctgctaagattacctttcagtgtaaacacacaagtgccctttcttcccatgttttgaacaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagttttgtaactcacaactcaaaaattagtctacctcatcccatggaaattggtgaaagtttagatggaactctcaaatcccgaaaacgaagaaaaatgtctaaaaagctgccccctgtcatcataaagtatattattattaatagatttagagggagaaaaaatatgcttgtgaagctaggaaaaatagactctaaagaaaaacaagtaatattaacagaagaaaaaatggaactatataaaaagcttgcacctttgaaggacttttggccaaaagttcccgactcccctgcaaccaaatatcccatttatccactaacaccaaagaaaagtcacagaagaaagtcaaaacataaatctgctaagaaaaaaactggtaaacaacaaaggacaaataatgaaaatattaaaagaactttgtctttcaggaaaaaacggtcacatgctattctttctcctccctcaccatcttacaatgctgaaaccgaagattgtgacctgaattatagtgatgttatgtctaaactaggttttctttctgagagaagcacaagtcccataaattcttctccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagcaaaagcaaaggggctttattttagatatgtcaaattttaaacctgaaagagtaaaaccgaggtcgttatcagaagcaatttcacaaaccaaagcactttctcagtgtaaaaatcgaaatgtgtcaacaccttcagcatttggtgaaggacagtctggactggcagttctaaaagaattgttacaaaaaagacagcagaaagcacaaaatgcaaatactacacaagacccattatccaataaacatcaaccaaataaaaatatttctggttcccttgagcataacaaagcaaataaacggacacgatcggtaacgtccccaagaaaacctcgaactcccagaagtacaaaacaaaaagaaaaaatccccaaacttctcaaagtagactctttaaatttacaaaactctagccagttggataactctgtatcagatgatagtcccatctttttttcagatccaggctttgaaagttgttactcacttgaagatagtttatctcctgaacataattataattttgatattaacacaataggtcagactggattttgtagcttttattctggaagtcagtttgtcccagctgatcagaatttgcctcagaagttcctaagtgatgctgttcaggatctttttccaggacaagctatagaaaaaaatgagtttttaagtcatgacaaccagaaatgtgatgaagacaagcatcataccacagactcagcctcatggattagatctggtactttaagtcctgaaatttttgagaagtcaaccatagatagcaatgagaatcgtcgccacaaccagtggaaaaatagctttcatcctctaacaactcggtctaactcaataatggattctttctgtgttcagcaggcagaagactgtctaagtgaaaaatctagattgaataggagttcagtaagcaaagaagtgtttcttagcctcccacagccaaacaattcagactggattcaaggtcacaccagaaaagaaatgggacagtctcttgactcagccaatacctcttttactgcaatactctcctcccctgatggtgaacttgtagacgtggcctgtgaagatttagaactgtatgtttcaagaaacaatgatatgttgacaccaactcctgatagttcaccaagatctactagctctccttcacaatctaaaaatggcagcttcacccctcgaactgctaacattctgaaaccacttatgtcccccccaagtagggaagaaattatggcaactttgttggatcatgacctgtctgagactatttaccaggaaccattttgcagtaatccttctgatgtaccagaaaagcccagggagattggtggacggctcctcatggtagaaactcgacttgcaaatgatctggctgagtttgagggagacttttccttggaaggacttcgtctttggaaaacagcattctcagcaatgactcagaatccaaggccagggtcaccccttcgcagtggccaaggagttgtcaataaagggtcaagtaatagccctaagatggttgaagataaaaaaattgtgattatgccttgcaaatgtgccccaagtcgacaactggttcaagtgtggcttcaagccaaagaagaatacgaacgttccaagaaactgcctaaaaccaagccaactggagttgtaaaatctgctgagaactttagctcttcagttaacccagatgacaaacctgtagtgcctccaaaaatggatgtaagtccatgtatactccccactacagcacataccaaggaggatgttgataattctcagattgctttacaagcaccaaccacgggatgtagtcaaactgcaagtgaaagtcagatgctgccaccagttgcctctgcaagtgatcccgaaaaagatgaagatgatgatgataactattacattagttatagctcccctgattctccagtaattcccccttggcaacaaccaatatccccagattccaaagcattaaatggagatgatagaccctcatcaccagtagaggagctgccttcattggcttttgagaacttcttaaagccaataaaagatggtatacaaaaaagcccctgcagtgagcctcaagagcctctagtgatatctccaattaatactagggcaagaactgggaaatgtgaatcactttgctttcatagtacaccaatcatacagagaaaacttctggaaaggcttcctgaagcacctggccttagcccattatcaacagaaccaaaaacacagaagttgagtaataagaaaggaagtaatactgacactcttagaagagtactgttaacacaagcaaagaatcaatttgcagcagtaaataccccacagaaagaaacttctcagattgatggaccatctttaaacaatacttacggtttcaaagtcagcatacaaaacttacaggaggcaaaagctttacatgagatacaaaatcttaccctaatcagtgtggagttgcatgctcgaactagacgagacttagaaccggatcctgaatttgacccaatctgtgctctgttctactgcatctcatctgacactccactgccagatacagaaaaaacagaactcacaggtgtaatagtgattgataaagacaagacagttttcagtcaagatatcagatatcagactccattacttattagatctggaattacaggactcgaagtcacctatgctgctgatgagaaggcactttttcatgaaattgcaaatataataaagaggtatgatcctgatattctgctaggatatgagattcagatgcattcctggggttacctcttacaaagggctgccgctttaagtattgacttatgtcggatgatctctcgggtgccagatgacaaaattgagaacagatttgcagctgaaagagatgagtatggatcatatacaatgagtgagataaatattgttggccgaattacactaaatctttggagaatcatgagaaatgaggtggctctaactaactacacctttgaaaatgtgagctttcatgttcttcatcagcgttttcccctctttacctttcgagtcttgtcagactggtttgataacaagacagatctatacagatggaaaatggttgatcattatgttagccgtgtccgtggaaatctccaaatgttagaacagctggacctgattgggaaaaccagtgagatggctagactttttggcattcagtttttacatgtactgacaaggggttcacagtaccgtgtggaatcaatgatgttgcgtattgctaaaccaatgaactatattcctgtgacacctagtgttcagcaaagatcccagatgagagccccacagtgtgttcctctaattatggagcctgaatcccgcttctatagcaactctgttctcgttttggatttccaatcactttatccttctattgtgattgcatataactactgcttttccacctgccttggccatgtggagaacttgggaaagtatgatgagttcaaatttggctgtacctctctgagagtacctccagatttactttaccaagttaggcatgatatcacagtgtcccccaatggagtagcttttgtcaagattgctaataaatgtaggccggaggggatggcttag

SEQ ID NO: 26147 - DNA, 4581 bp, Homo sapiens
ggtccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggctccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggattttaga

SEQ ID NO: 26148 - DNA, 4348 bp, Homo sapiens
atgctgccttccagcaccaggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggattttaga

SEQ ID NO: 26149 - DNA, 1801 bp, Homo sapiens
aatgagcaggtgggggcacccgagacccttcggtcctctgtccgggagccagggcctttccctcagacatcgacgccttgggcttggggtcagaacacgtggcagaggcctggaccaccccaccggtgacgtgtcctcagcggcctccgcagcctgacctgtgtcctctgcctcgatggacttgcctgaaggcagctagagcctggtgctccgccacgtggtgatgggcagccactcgccctgtgcccacaccccctgtgccccgccagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtc

SEQ ID NO: 26150 - DNA, 1161 bp, Homo sapiens
gttgagggcgagccggcgcaccgtacgctgggacgtgtggtttcagctcgtgcgcctccccgtgggtttgcgacgtttagcgactattgcgcctgcgccagcgccggctgcgagactggggccgtggctgctggtcccgggtgatgctaggcggctccctgggctccaggctgttgcggggtgtaggtgggagtcacggacggttcggggcccgaggtgtccgcgaaggtggcgcagccatggcggcaggggagagcatggctcagcggatggtctgggtggacctggagatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttgatgccagttatcatgctgccactacatcgttatctggaggcaacttctggtggtttttttttctcacgctgatggcttggcagagcaccttcggttaacttgcatctccagattgattactcaagcagacagcacacgaaatactatttttctcctaatatgctgtttccattatgacacagcagctcctttgtaagtaccaggtcatgtccatcccttggtacatatatgcatttgcttttaaaccatttcttttgtttaaataaataaataagtaaataaagctagttctattgaaatgcaaa

SEQ ID NO: 26151 - DNA, 1753 bp, Homo sapiens
ggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgagagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttgg

SEQ ID NO: 26152 - DNA, 2360 bp, Homo sapiens
gcgcttccggggactggagcgtgcgtgctgaggtatgcgcaacgcgtgcggggtctcttccggagtcttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaactgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaa

SEQ ID NO: 26153 - DNA, 860 bp, Homo sapiens
atactctgcacagtatctcagtgcagacattcctgtcttaacacacaggaccagtcaaattcccgtgggcagccccagggttctgtgggatttcttgaacaccaactcttcttccttctcccaagaaagaaaagcaaaataagtgaatggaagggatgtgtgctatagggaaactttggagtgttttctaattcatccaagaaagtcagcccttcagttctttacctatcacagaacagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaacca

SEQ ID NO: 26154 - DNA, 2026 bp, Homo sapiens
cccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgaggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcggcctgacaagagccttagccttggactgtgagatggtgggcgtgggccctaagggggaggagagcatggccgcccgtgtgtccatcgtgaaccagtatgggaagtgcgtttatgacaagtacgtcaaaccaactgagcccgtgacggactataggacagcggtcagtgggattcggcctgagaacctcaagcagggagaagagcttgaagttgttcagaaggaagtggcagagatgctgaagggcagaattctagtggggcacgctctgcataatgacctaaagagtggaaggccgtctctgagactactttcagagaagatccttgggctccaggtccagcaggattcaggatgcccaggcagcaatgaggctgtacgtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggacggccatgggcacgcctggccacgctttaccgactgctgaccccctgggccaggtgaggttggggcctgtgggccgccagtccatacggtgctgtcactgcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgaactttgagcatttatctaaattaaattggcccagggttggctggtgggtcacccagcagaggcttctccccatagcacgaggatgtgttgcctgggcacggtgactgcggttattcctggaggtcggcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaaaggggcagacacaccgaggatgcgatttaaaataaatgcagatgtttacttggaa

SEQ ID NO: 26155 - DNA, 833 bp, Homo sapiens
ttttcctggacggggtccctgcggtgggtgtgtttcggcctggcctgggcaggcgcttgtgctgccagggcgccgggcccggggaggccggggtctcgggtggccgccggcccaggcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagaggttccaagatggacaggagggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgagagaagagcttgaagttgttcagaaggaagtggcagagatgctgaagggcagaattctagtggggcacgctctgcataatgacctaaaggtactatttcttgatcatccaaaaaagaagattcgggacacacagaaatataaacctttcaagagtcaagtaaagagtggaaggccgtctctgagactactttcagagaagatccttgggctccaggtccagcaggcggagcactgttcaattcaggatgcccaggcagcaatgaggctgtacgtcatggtgaagaaggagtgggagagcatggccc

SEQ ID NO: 26156 - DNA, 1828 bp, Homo sapiens
gcggccgcatgagccgcgcgcgtggggcgctgtgccgggcctgcctcgcgctggccgcggccctggccgcgctgctgttactgccgctgccgctgccccgcgcgcccgccccggcccggacccccgccccggccccgcgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgccaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacataacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccacaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatcccacgggaacaggcttccaccccagcacttgcgcacctgggagggagctgccatccgggctccattacctgttgctgaaggcgggtgctaggctggctgggtgtcaaggagcaggctccaggccaaggtcctggcccagccacggccattgcaagggctcagcctggcaggctttgtgggggacgccgccctctctgccgcaggctgggtgcacggccgggcaccacagtgggactcaggcccgggaaggtcatgttctcgaccagagctttgctcccagtccaggcgcctcattcggaggcctcttgactgggaccacagagatgttttctccgctctgacttgtggctcaggactactttctgggtcgtgctcctgccccactgtgcctgggcccataaacaacaggagccttttgttccgctgacctgcccatcccagcagacccacctccccgcctggtgccttccatggagggaaatgggacaggggccgtcatctcccctctgcctcctgctttgctgttgccgagcacgagtaaagcttttgttcttacttca

SEQ ID NO: 26157 - DNA, 1214 bp, Homo sapiens
gttcttaaaggggccgccgcccacccacggctccggccaggttctccgctcgcagcgccgggggtcccggcggccgcatgagccgcgcgcccccgtcccggcccgctgcccccagcctgcggcctgacgacgtcttcatcgccgtcaagaccacccggaagaaccacgggccgcgcctgcggctgctgctgcgcacctggatctcccgggcccgccagcagacgtttatcttcaccgacggggacgaccctgagctcgagctccagggcggcgaccgtgtcatcaacaccaactgctcggcggtgcgcactcgtcaggccctctgctgcaagatgtccgtggagtatgacaagttcattgagtccgggcgcaagtggttttgccacgtggatgatgacaattatgtgaacgccaggagcctcctgcacctgctctccagcttctcacccagccaggacgtctacctggggcggcccagcctggaccaccccattgaggccaccgagagggtccagggtggcagaactgtgaccacggtcaagttctggtttgctactggtggggccgggttctgcctcagcagaggccttgccctcaagatgagcccatgggccagcctgggcagcttcatgagcacagctgagcaggtgcggctgccggatgactgcacagttggctacatcgtggaggggctcctgggcgcccgcctgctgcacagccccctcttccactctcacctggagaacctgcagaggctgccgcccgacaccctgctccagcaggttaccttgagccatgggggtcctgagaacccacataacgtggtgaacgtggctggaggcttcagcctgcatcaagaccccacacggtttaagtctatccattgtcttctgtacccagacacggactggtgtcccaggcagaaacagggcgccccgacctctcggtgacaccaaccaccccgacccagggctgcctggctctgtcccaggcgcggggaaccagagccccctatgggctcagtgggctccctcaggtgccacggccacaccagtgagatgcaggcacctggcagaccctctggctagcctgcagccccccctctcccagcccctggtgggctgcggtgatgggtgttttgggagaacgaagacagccaggctgatggccagggccgcagtgcccctccccccgacccagccccaaggttgatc

SEQ ID NO: 26158 - DNA, 5108 bp, Homo sapiens
cttatcgcgactaaacggagtggcggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagactaacgctgctttactcaaccaccctcttcctggccagagaggccttccgcagagcatgtctcagtgggggcacccagcgagactggagccagaccctcaacctgctgtggctaacagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagttttttatcattttatagtaatcagcattttctcttttactaatatactcattccttttgcgtatgattggcctttggagctacatgctccaacaaactatatcttaattgttaactgttaataattatctggcccagaaaaagagatgcagtgattttacccttcacaggaatattgaacttcttctgtaaaagagagagagaaacctctctctctcatgcaccacatggaaacagagtgtggccctgaagttgtggctttctttgtgtcaaaactgtggtctgagtttttagagaaggaaaaatgctactcagtgagaaatccaagaaatgaaaccaggaaggttttcagatcacatttcccagagtgagttcgggagaatcttgcctgtcgtgatcacactgttccccgccgccccaggtcagcacatacttgacccagagtgggctctcaggatttgttgattgaagggtgggtgaaagctggctggagactcctggcctggccacctgcaagaggcggactttgaagaaaactgtgatccagttgagccactttgtccctgaggggaatgctgctttgcagctttctgtaacttctcacatgggaattgcactggtgacagataaggtttaacagatgtacttttttatcctcagaataagacaaggcaaactctatatggctagtattactgagtcaggtccctcccgttgacccattaattccagcattgatcaatacaaccaaattccagccccaggacaagagtggcaggcatgggggcctggtactccaggctacagtgtgagcccaggtgttctgcaccttgcagcctgcacactgcaggtgaaatcatgagcagtgttctggagtgtgaagtgtttttatttttttgttaatgtattaattccttttagatattaacccccctcagaactatatgcacaaactataacttggatgttaataatcctgtcactcagtgccccaaaccttctgtgtctacacctagagagagggccagtaagggcaactcctatcatgcattaaaatgcatgtatttaaatctgcttgcccagagccagtacccaggggctaaggattaagacctgtcagtacaccaagactggggcccagtcacctggcaggtttttatctactcagagggagaatgctttgcactaagtgggagaaaagcagctaaatgcaaggtgtcctgagcaattagaggacctccaaagcatggcctcagtcatgccttcatcgggcaaggtcaggccagctcagaaaaatggatggtcccatagggtcaagtggagcacacacggaaggcagtcctccttccctcccatgtcctttctctgtccctggcatccacagaaagggaccttcagtcctcatgagctgcttctctgcagctgctgatcaccctcccggaaccctgcacctatcccgtgcccacctgaccccagactcaagcatgatcctcattctacctgcctcggaatcacctggattgcaagtcagaacatggcttcccaggacccactccaggccttcagggtctgtgtctcccaggaggagggctctgagattggcttttctggcaagcccacgtggctttgatgccaccaaggttggcatgccccattgtcttccttcgtgacaggcccaggaccatcatgctcatgctcacagtgcctgttctctgctccaggaacagagctgctgctctacaagcagccttgtgactccggggtctctgggagcaggactccccaggcttgtgctctctcagcttgagagaggctctatgtctgaaggcagtgctcactctctcatccctcccctgctgttcgcccagtgctgctgtcagggccagctcctcttgaaagacagccagccgcaaaggcagcccagggcttcttccggtgtcctgcttccctgtatctagggagagttgtacatgtggctgcgtgttttcccaggactagccctgccgcctgggctgtcagcactttggcagcaggtcctctgtggttctctgcctctggtgcctccctaaagctcagctggacctgaccaggcctctggcatttcccctgctggaccccctagagccacagctgtgcctcagggagcttgcatacatgtgggccagcctgcctcactttacccaagtggatttggggagcagaaatcatacttttggctttcaataccacttatagtgaggctacttctccatggaaacaagtctctgaggcacaacctttatgaaaggaaggagcattcgttggtgagaagaacagtatcgctgacttcctgtgctcctctggccacaggtaactgttggtcacttcagatttggcttggggtctctcagtgaggagctgctgctgtgctgtttaatgcttacctgatggcaacttctggctctggaaccgctactctgccctgttcccagccacttcccaacctgattcaagcagggcccctccttcctcctgtctttatttatttatttattgagacagagtctcactctgtcgcccaggctggagtgcagtagcgcgatctcggctcactgcgagctctgcctcctgggttcaagcgattctcttgcctcagcctcctgagtagctggggctacaggcgcctgccaccacacccggctaatttttgtatttttagtagagacagggtttcaccatattggccaggctggtcttgaactcctgaccttgtgatccgcccgcctcagcctcccaaagtgctgggattacaggcgtgagccaccgctcctggcctattcttttcttttcagagacaaggtctcactctctcctctcgcccaggctggagtgcagtggtgtcatcatagctcattgcagcctcaaactcctgggctcaagcaatcctcccacctcagcctcctgagtagctgggatcacaggtgtgtgctacctcacccagctaatttctaatttttttttgtagagactggatctcactgttgccttgaactcctgggctcaagtgatcctcctgcctcagcctcccaaagtgctgggattccagaccagccattttttttccttaatcatgcattcctgttgctagtttcacatcagtcccctggtttaataagaaataaaatattttcttcacacttttgaaaa

SEQ ID NO: 26159 - DNA, 1800 bp, Homo sapiens
actaaacggagtggcggcggcatttcctggtgtctgagcctggcgcggaggctatgggcagccaggaggtgctgggccacgcggcccggctggcctcctccggtctcctcctgcaggtgttgtttcggttgatcacctttgtcttgaatgcatttattcttcgcttcctgtcaaaggaaatcgttggcgtagtaaatgtaagagtccccctgggtgtgttttggtccttattcctgggctggatctggttgcagctgcttgaagtgcctgatcctaatgttgtccctcactatgcaactggagtggtgctgtttggtctctcggcagtggtggagcttctaggagagcccttttgggtcttggcacaagcacatatgtttgtgaagctcaaggtgattgcagagagcctgtcggtaattcttaagagcgttctgacagcttttctcgtgctgtggttgcctcactggggattgtacattttctctttggcccagcttttctataccacagttctggtgctctgctatgttatttatttcacaaagttactgggttccccagaatcaaccaagcttcaaactcttcctgtctccagaataacagatctgttacccaatattacaagaaatggagcgtttataaactggaaagaggctaaactgacttggagttttttcaaacagtctttcttgaaacagattttgacagaaggcgagcgatatgtgatgacatttttgaatgtattgaactttggtgatcagggtgtgtatgatatagtgaataatcttggctcccttgtggccagattaattttccagccaatagaggaaagtttttatatattttttgctaaggtgctggagaggggaaaggatgccacacttcagaagcaggaggacgttgctgtggctgctgcagtcttggagtccctgctcaagctggccctgctggccggcctgaccatcactgtttttggctttgcctattctcagctggctctggatatctacggagggaccatgcttagctcaggatccggtcctgttttgctgcgttcctactgtctctatgttctcctgcttgccatcaatggagtgacagagtgtttcacatttgctgccatgagcaaagaggaggtcgacaggtacaattttgtgatgctggccctgtcctcctcattcctggtgttatcctatctcttgacccgttggtgtggcagcgtgggcttcatcttggccaactgctttaacatgggcattcggatcacgcagagcctttgcttcatccaccgctactaccgaaggagcccccacaggcccctggctggcctgcacctatcgccagtcctgctcgggacatttgccctcagtggtggggttactgctgtttcggaggtattcctctgctgtgagcagggctggccagccagactggcacacattgctgtgggggccttctgtctgggagcaactctcgggacagcattcctcacagagaccaagctgatccatttcctcaggactcagttaggtgtgcccagacgcactgacaaaatgacatgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggggggagtttcatttttaagtgaagaccaaaagccctttaaaaataatagtttt

SEQ ID NO: 26160 - DNA, 4463 bp, Homo sapiens
tccgccgccggaggagcaggtggctgccgtgcgggtctgggccccaggcttcctgtgtgcgcgctcgtcctctgctgtttcccgccggagctcgttgggcctccccggcccgcccggcccatggcccagacccccgacggcatctcctgtgagctccgaggcgagatcaccaggttcctgtggcccaaagaggtggagctgctgctgaaaacctggctacccggggagggtgctgtgcaaaaccatgtcctggcactgctacgatggagagcctacctgctgcacaccacctgcctcccgctgagggtggactgcacgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtgcctctcctgtgtggacatgaagctgagccttgaggtctcagaacagattctgcacatgatgagtcagtcatcacacctggaggagctggtgctggagacctgcagcctgaggggagactttgtccgacgactggcccaggcgctggcgggacactcaagctctgggctgcgggagctcagcctcgcggggaacctgctggatgaccgaggcatgactgcactcagcagacacctcgagcgttgtccaggagccctgaggagactcagcctggcccagacagggttgacaccgcgaggaatgagggctctgggccgggcactggccaccaatgccgccttcgactccaccctgacccacctggacctttctgggaatcctggggcgctgggggcctccgaggacagtgggggcctctatagcttcctgagccgtcctaacgtactgtcgttcctgaatctcgcaggcaccgacactgccctggacactgtgagggggtgctccgtggggggatggatgaccggcagggcggactggagggcgggacggggagggctcggtccccccgcgggtgtagccaacagcctccccccgcagctcttcgcagcggtatcccgaggctgctgcaccagccttacccacctcgacgcttcgaggaacgtcttctcccgcacgaagtcccgcgccgcgccggccgcgctgcagctcttcctcagccgcgcgcggacgctgcggcacctgggcctggcgggctgcaagctgccgcccgacgcgctcagagcccttttggatggcctcgcgctcaacacgcacctccgcgacctgcacctggacctcagcgcttgcgagctgcgctcggccggcgcccaggtgatacaagacttagtgtgcgacgcaggcgctgtgagctccctggatctggcggataacggcttcggctcagacatggtgactctggtgctggccatcgggagaagccggtccctgagacatgtggcgcttggaaggaacttcaacgtccggtgcaaggagaccctggacgacgtcctgcaccggattgtccagctcatgcaggacgacgattgtcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggccaaggcgctgcgggtcaactcgaggctccggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagatggccagctgaggccgaggcctctctcggcagggcggcgagcagtgtctgtgcatgaggaccagctccaggcccctgctgaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttatt

SEQ ID NO: 26161 - DNA, 4378 bp, Homo sapiens
tccgccgccggaggagcaggtggctgccgtgcgggtctgggccccaggcttcctgtgtgcgcgctcgtcctctgctgtttcccgccggagctcgttgggcctccccggcccgcccggcccatggcccagacccccgacggcatctcctgtgagctccgaggcgagatcaccaggttcctgtggcccaaagaggtggagctgctgctgaaaacctggctacccggggagggtgctgtgcaaaaccatgtcctggcactgctacgatggagagcctacctgctgcacaccacctgcctcccgctgagggtggactgcacgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtgcctctcctgtgtggacatgaagctgagccttgaggtctcagaacagattctgcacatgatgagtcagtcatcacacctggaggagctggtgctggagacctgcagcctgaggggagactttgtccgacgactggcccaggcgctggcgggacactcaagctctgggctgcgggagctcagcctcgcggggaacctgctggatgaccgaggcatgactgcactcagcagacacctcgagcgttgtccaggagccctgaggagactcagcctggcccagacagggttgacaccgcgaggaatgagggctctgggccgggcactggccaccaatgccgccttcgactccaccctgacccacctggacctttctgggaatcctggggcgctgggggcctccgaggacagtgggggcctctatagcttcctgagccgtcctaacgtactgtcgttcctgaatctcgcaggcaccgacactgccctggacactgtgagggggtgctccgtggggggatggatgaccggcagggcggactggagggcgggacggggagggctcggtccccccgcgggtgtagccaacagcctccccccgcagctcttcgcagcggtatcccgaggctgctgcaccagccttacccacctcgacgcttcgaggaacgtcttctcccgcacgaagtcccgcgccgcgccggccgcgctgcagctcttcctcagccgcgcgcggacgctgcggcacctgggcctggcgggctgcaagctgccgcccgacgcgctcagagcccttttggatggcctcgcgctcaacacgcacctccgcgacctgcacctggacctcagcgcttgcgagctgcgctcggccggcgcccaggtgatacaagacttagtgtgcgacgcaggcgctgtgagctccctggatctggcggataacggcttcggctcagacatggtgactctggtgctggccatcgggagaagccggtccctgagacatgtggcgcttggaaggaacttcaacgtccggtgcaaggagaccctggacgacgtcctgcaccggattgtccagctcatgcaggacgacgattgtcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggccaaggcgctgcgggtcaactcgaggctccggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaacccctccccagacagcctgggcctcccagaggacccttgcttgggccccagaaatgaagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctgatcctctcctctcctgccgcatgagattattttatt

SEQ ID NO: 26162 - DNA, 4119 bp, Homo sapiens
atggcccagacccccgacggcatctcctgtgagctccgaggcgagatcaccaggttcctgtggcccaaagaggtggagctgctgctgaaaacctggctacccggggagggtgctgtgcaaaaccatgtcctggcactgctacgatggagagcctacctgctgcacaccacctgcctcccgctgagggtggactgcacgttcagctacctggaggtccaggccatggcgctgcaggagacaccccctcaggtcacctttgagctggagtccctgcgtgagctggtcctggagtttcctggtgtggccgccctggaacagctggcccagcacgtggctgcagccatcaagaaggtcttccctcgctcgacccttgggaagctattccggaggcccacaccagcctccatgctggctcggctggagagaagcagcccctcggagtccactgacccctgcagcccctgtggtggcttcttggagacatacgaggctctgtgtgactacaatggcttccctttccgagaggagattcagtgggacgtggacaccatttaccatcgccagggctgccgccatttcagcctgggagacttcagccacctcggcagtcgggacctggccttgagtgtggctgccctgtcctacaacctgtggttccggtgcctctcctgtgtggacatgaagctgagccttgaggtctcagaacagattctgcacatgatgagtcagtcatcacacctggaggagctggtgctggagacctgcagcctgaggggagactttgtccgacgactggcccaggcgctggcgggacactcaagctctgggctgcgggagctcagcctcgcggggaacctgctggatgaccgaggcatgactgcactcagcagacacctcgagcgttgtccaggagccctgaggagactcagcctggcccagacagggttgacaccgcgaggaatgagggctctgggccgggcactggccaccaatgccgccttcgactccaccctgacccacctggacctttctgggaatcctggggcgctgggggcctccgaggacagtgggggcctctatagcttcctgagccgtcctaacgtactgtcgttcctgaatctcgcaggcaccgacactgccctggacactctcttcgcagcggtatcccgaggctgctgcaccagccttacccacctcgacgcttcgaggaacgtcttctcccgcacgaagtcccgcgccgcgccggccgcgctgcagctcttcctcagccgcgcgcggacgctgcggcacctgggcctggcgggctgcaagctgccgcccgacgcgctcagagcccttttggatggcctcgcgctcaacacgcacctccgcgacctgcacctggacctcagcgcttgcgagctgcgctcggccggcgcccaggtgatacaagacttagtgtgcgacgcaggcgctgtgagctccctggatctggcggataacggcttcggctcagacatggtgactctggtgctggccatcgggagaagccggtccctgagacatgtggcgcttggaaggaacttcaacgtccggtgcaaggagaccctggacgacgtcctgcaccggattgtccagctcatgcaggacgacgattgtcctcttcagtctctgtcggtggctgagtctcggctgaagctgggtgccagcgtcctactccgggccctagccaccaatcctaacctgaccgcgctggatatcagcggcaacgccatgggggacgcgggcgccaagttgctggccaaggcgctgcgggtcaactcgaggctccggtctgtggtctgggaccggaaccacacatctgctttgggtctgctggacgtggcgcaggcgctggagcagaaccacagcctgaaggccatgcctctgccactgaacgacgtggcccaggcgcagcgcagccgcccggaactgacagcacgtgcagtccatcagatccaagcctgtctcttgaggaacaaccgcgcagaccctgcctcttctgaccacacgacccgccttcagccacttggtctggtctcagacccctcagagcaggaagtgaatgaattgtgtcagtcggtgcaggagcatgtggagctgctgggctgtggggctgggccccagggtgaagccgctgtgcgccaggccgaggatgccatccaaaatgccaacttctctctcagcattctccccattctatatgaagctggaagctccccaagccatcactggcagcttgggcagaagctggagggccttctgagacaggtgggcgaggtctgccgccaggacatccaggacttcactcaggccacactggacacagcaaggagcctctgcccacagatgctgcagggatccagctggagggagcagctagagggggtcctggcaggctcgaggggcctcccggagctgctcccagagcagctgctgcaagatgccttcactaggctcagggacatgcggctatcaatcacggggaccttggcagagagcattgtggctcaggctttggcaggcctgagtgcagcccgggatcagctggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggatgacagtcctccacagaaatggcctgagctcagccacggtcttcacctggtccccttcattcacagtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtacccccagccttgccgcaggaagggaatgggctcagtgcccgcgtggacgagggcgtggaggaattcttctccaaaaggctgatccagcaggatcgcctctgggcccccgaggaggacccggccactgaggggggcgccactcctgtcccccgtacactgcgaaagaagctgggcaccctctttgccttcaagaagcctcgttcaacgcggggtccacggactgatctagagaccagccctggggcagctccccgaacccgaaaaactacatttggcgacctactgcggccgccaacccgtcccagccgtggtgaggagcttggtggggctgagggggacaccagcagccctgaccctgccggcaggagccgacctcgctacacaagagatagcaaggcctactcgatgatactgctgcctgccgaggaggaggcaacgctgggtgccagacccgacaagcggcggcccctggagcggggagaaacagaactggctccatcctttgaacagcgggtacaagtaatgctgcagaggataggcgtcagccgaggcagcgggggtgccgaaggcaagaggaagcaaagcaaagatggcgagatcaagaaagctggctcagatggtgacattatggacagttccacggaggcccctcccatctcgatcaagtcccgcacccactctgtgtctgctgacccttcctgcagacctggcccagggagccaggggcctgagtctgccacctggaagacactggggcagcagttgaatgcggagctcaggagccgtggttggggccaacaggatggtccaggccctccctcccctggtcaaagcccaagtccctgcagaaccagcccctccccagacagcctgggcctcccagaggacccttgcttgggccccagaaatgaagaacggcccctgaggctgcagcgctcccccgtcctcaaacgcaggccaaaactcgaggcacctccatccccaagcctaggatctggccttggaaccgagcctctgcccccacagcccacagagccctccagccctgagcggagcccaccctccccagccacagaccaaagaggcggcggccccaatccctga

SEQ ID NO: 26163 - DNA, 3038 bp, Homo sapiens
cgcccgcggccgaggtggacggagcctcccggctcgctgctcccgccggcggagcgaggctgccctttcttcgcagcgtgatttattttcttctttttttctgaactcttcttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgtta

SEQ ID NO: 26164 - DNA, 3216 bp, Homo sapiens
agttgtctcccgagcgctggctgcgccgcccgagccgctgggccggggaagcactggccgttcgctcccgggccggctccgccaggcgctcgcaggcatgcagcccgggagcaggaggcgctccccgggccgctgctgagccggccggggcggcggggaccagcgccagcggagcccctcccaccttgccccggggcagacgagcggcgccccgacaccccctcttctcccgcagccccgccagcgccaccccccgcgggccgcaggggctcatgcagccgccaagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttt

SEQ ID NO: 26165 - DNA, 3078 bp, Homo sapiens
gtagctgagatgcagagagccatcctgcccagacctagacaactcggaagtgggtttttcagcctcctgcaccggtgtcgcgtctgagtgcgactgatgagccagggggcgtcggtggaagcttggggtcggcagtctggttggaaaggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttta

SEQ ID NO: 26166 - DNA, 3172 bp, Homo sapiens
agacctagacaactcggaagtgggtttttcagcctcctgcaccggtgtcgcgtctgagtgcgactgatgagccagggggcgtcggtggaagcttgggggagaggctagtggtaacaggccgagctggatggatgggtatggggagaggggcaggacgttcagccctgggattctggccgaccctcgccttccttctctgcagcttccccgcagctattaaaagaagcccaggaagtttctgcgcagcgttggagatgaggagactgtggaatttgatgtcgtggaaggagagaagggtgcagaagccgctaatgtaactgggcccggggaggtgcccgtgaagggcagctgttatgcccccaacctacccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgtt

SEQ ID NO: 26167 - DNA, 3174 bp, Homo sapiens
ctcccgctcgacgcccggctgcggagctgcctggccatctcctgccctcggggatgtcggcgcagtgcaccgcgtgggctcgcgtcccggcggccctttgcctcggcgcgccggcgtacgggaaggtgcggaccttggattgagggccgaggatgcccattgccaagccgccccggctttcctaagtggacgggagggcacggcgacgattcagcgccggctcgcgccgcagctcaacccaggggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttagttggtccctatgttggaagtaaaaagtgaagcactttattttggttgtgtttgctcacgttctgcttggaagtggggacccctcactgcgtccacgtgtctgcgacctgtgtggagtgtcaccgcgtgtacatactgtaaattatttattaatggctaaatgcaagtaaagtttggtttttttgttattttctttta

SEQ ID NO: 26168 - DNA, 1664 bp, Homo sapiens
aaggttaggcccgcaggccctcagcacgggggcgcagccggggcaagtcttcaggaagcagcgaggtgcttgaagggggtgctggaggcaggccaaacccagtcaggatgggtggcctggggccacgacgggcgggaacctcgagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcagctacgccctgtgcacgcggcggacggcccgcacctgccggggtgacctggcctaccactcggccgtccatggcatagaggacctcatgagccagcacaactgctccaaggatggccccacctcgcagccacgcctgcgcacgctcccaccggccggagacagccaggagcgctcggacagccccgagatctgccattacgagaagagctttcacaagcactcggccacccccaactacacgcactgtggcctcttcggggacccacacctcaggactttcaccgaccgcttccagacctgcaaggtgcagggcgcctggccgctcatcgacaataattacctgaacgtgcaggtcaccaacacgcctgtgctgcccggctcagcggccactgccaccagcaagctcaccatcatcttcaagaacttccaggagtgtgtggaccagaaggtgtaccaggctgagatggacgagctcccggccgccttcgtggatggctctaagaacggtggggacaagcacggggccaacagcctgaagatcactgagaaggtgtcaggccagcacgtggagatccaggccaagtacatcggcaccaccatcgtggtgcgccaggtgggccgctacctgacctttgccgtccgcatgccagaggaagtggtcaatgctgtggaggactgggacagccagggtctctacctctgcctgcggggctgccccctcaaccagcagatcgacttccaggccttccacaccaatgctgagggcaccggtgcccgcaggctggcagccgccagccctgcacccacagcccccgagaccttcccatacgagacagccgtggccaagtgcaaggagaagctgccggtggaggacctgtactaccaggcctgcgtcttcgacctcctcaccacgggcgacgtgaacttcacactggccgcctactacgcgttggaggatgtcaagatgctccactccaacaaagacaaactgcacctgtatgataggactcgggacctgccaggcagggcggctgcggggctgcccctggccccccggcccctcctgggcgccctcgtcccgctcctggccctgctccctgtgttctgctagacgcgtagatgtggagggaggcgcgggctccgtcctctcggcttccccatgtgtgggctgggaccgcccacggggtgcagatctcctggcgtgtccaccatggccccgcagaacgccagggaccgcctgctgccaagggctcaggcacggacccctccccttctagtgcacgtgacaagg

SEQ ID NO: 26169 - DNA, 4580 bp, Homo sapiens
atttgaggctgactggggagaaagctgcctggaggaagctgctggggtgcggggggctgagggatttggctccccgccctctcccctagatggcggagaaatcgggctagctggaagggcgcagctcctctcccagagctcattctggagtcggagaactgggagagcggcccccgaggcggagcctccctcccgccccgagtcgcgctgccccccacctgggggagaggggcgggcgccgcgctgccttccctccgcgcctcggccgcgtggcttgcggcttattttcccagctggcaagcgtcgcgctgcagacaagggaatgcctgtggtcctgcgtgttccgaagttcaggggccccctgatcccgctgagccccctccaggagcgaaagggttaagaatgataaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtgcttggttgatatgtatagtacatatacacagacatccatatgcagcgtttcctttgaaggtgaccagttgtttgtagctattcttggctgtaccttcctgccctttcccattgctactgatttgccacggtgtgcagcttttactcgccaccttccggtggagctgcctcgttcctttgaactatgccctcacccttctgccctcacttgatttgaaagggtcgttaactctcccttacaggtgctttgactcttaaacgctgatcttaagaagctctcttcatctaagagctgttactttttcagaagggggggtattattggtattctgattactctcaattctaattgttatatatttgagcccatacagtgtattaggttgaaccatagaaactgctattctcgtaggtcaaaagggtctagtgatggaagttttgtagataagtaccaggcatctcagtaactcctagactttttctcatcccatgccccgttttaaattgtcagttttccctctgactcttctgtgttaaaacatgaaactataaatttagtaattatcatgccttgctctttttaatctatatgactgatgcaagcccctcttcttaaccgtttcttggctttgagcccagaaacacagctctccctgtctccaactccagtaagccctcctcagcctcaccttacgaatccaaagaactggggtttgttaggttctttctctaatgtagaggcccagatcccatcacaaagtttttcattcttccttgtccaccatgatcttcatcacagtctttgatatgtctgcatgcaaagtggaacagagttgggcggcaatgacagaagagcttccttggcctgactcggtgtgcggccacttcggcactgcttaatccagatattcttgttaactaagcattgtgcttcccaggtggtctgaagtcaggtactctctctctcaacacctgtagttgaatatgatttggtcagttgctcgttgtaacttggagaaattcctataaagtaagatctccttgcctcttccatccattgttggcacccccttgcaaaaggaaaagaacagcaaaagtcaggagcagtaatctgagaaagttaactccaggataggtaggtttctattgttatagctagatgtaaatctttagttccaagaagtgatagagtttctgctttaataatttgttgataagtttacataaacagaaataaaagatactatctttaccgtagtagttcaggccaagattatgcttagttttagttctccaggtagttacttttgccatgtcctattgatcagtgacactgccagaggcccataccggcaagaggaagaggacgtcattttgtaaagtttaacttcttagcgaactgatgtgccacccagtcacagagtggagttgtgaattcatgtagaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaataatatgaaagtgaagtaaaagcaatagaagaaatttctataggatctgggtttagagtgtgtatcattaataaatatacctttgctcttttcagggaaaataacaaccacccttactgatagttgggaaaagaagattgggttattttgccatatcatttagctggaagtgacatttaaaagcaccctgcatcactagtaatagtgtattttgctattctgcccttgtaatcggtgtccctgtaaaacaatccccacagattactttcagaaatagatgtatttctctacgtaagggccaggtttattttctccttttttgagatttctagaaaaaatgctgcttgcacatgttggttcttgaaaccttagctagaagaatttcaggtcataccaacatgtggataggctatagctgttcagaggtctcctgggggagcttaaaacgggggaaacactggttttcacagatgctccacatggctgtctttaaaagactcaaaacttttttttgtcctctttgttatgcttggaagctcccccccccccaacagtgtgtcgagtctttgcaaagaaacctttagatgtggttcatagatatatgaatacgtatctgtgtaaaacagtgagtgtgcagtgtgtaaatactttaaattattatgctagaaaaataaagttacataccttgctgtggaa

SEQ ID NO: 26170 - DNA, 2052 bp, Homo sapiens
gagattgatcgaccgcgggggctgccgcgcagagatatccgggccgccggtgggtggtcgctagggctgggccagcctcttggaggtccacgcccgccgagcccacgctggctggggccggggtgccggcgcgctcgggactcgtctcagcagtcgctcacggtctttgtgtcttctcttccgcccctttccctgcctgccgcctccggccgccacgatgcccctgcgccccgctgctgccgccgcggactggctgcgccggctgcgcgctgcttgctgcggcggtggtggcgccccatctgctacacgggcctgaagaaggaagaagaggaagcgaagcgcgccccccggcccatgccgcagccacgggcccagacccgccacggcgcccgcgccgccgccctcgccggagcccacgagacctgcatggacgggcatgggcttgagagcagcaccttccagcgccgccgctgccgccgccgaggttgagcagcgccgcagccccgggctctgccccccgccgctggagctgctgctgctgctgctgttcagcctcgggctgctccacgcaggtgactgccaacagccagcccaatgtcgaatccagaaatgcaccacggacttcgtgtccctgacttctcacctgaactctgccgttgacggctttgactctgagttttgcaaggccttgcgtgcctatgctggctgcacccagcgaacttcaaaagcctgccgtggcaacctggtataccattctgccgtgttgggtatcagtgacctcatgagccagaggaattgttccaaggatggacccacatcctctaccaaccccgaagtgacccatgatccttgcaactatcacagccacgctggagccagggaacacaggagaggggaccagaaccctcccagttaccttttttgtggcttgtttggagatcctcacctcagaactttcaaggataacttccaaacatgcaaagtagaaggggcctggccactcatagataataattatctttcagttcaagtgacaaacgtacctgtggtccctggatccagtgctactgctacaaataagatcactattatcttcaaagcccaccatgagtgtacagatcagaaagtctaccaagctgtgacagatgacctgccggccgcctttgtggatggcaccaccagtggtggggacagcgatgccaagagcctgcgtatcgtggaaagggagagtggccactatgtggagatgcacgcccgctatatagggaccacagtgtttgtgcggcaggtgggtcgctacctgacccttgccatccgtatgcctgaagacctggccatgtcctacgaggagagccaggacctgcagctgtgcgtgaacggctgccccctgagtgaacgcatcgatgacgggcagggccaggtgtctgccatcctgggacacagcctgcctcgcacctccttggtgcaggcctggcctggctacacactggagactgccaacactcaatgccatgagaagatgccagtgaaggacatctatttccagtcctgtgtcttcgacctgctcaccactggtgatgccaactttactgccgcagcccacagtgccttggaggatgtggaggccctgcacccaaggaaggaacgctggcacattttccccagcagtggcaatgggactccccgtggaggcagtgatttgtctgtcagtctaggactcacctgcttgatccttatcgtgtttttgtaggggttgtcttttgttttggttttttattttttgtctataacaaaattttaaaatatatattgtcataatatattgagtaaaagagtatatatgtatataccatgtatatgacaggatgtttgtcctgggacacccaccagattgtacatactgtgtttggctgttttcacatatgttggatgtagtgttctttgattgtatcaattttgttttgcagttctgtgaaatgttttataatgtccctgcccagggacctgttagaaagcactttattttttatatattaaatatttatgtgtgtg

SEQ ID NO: 26171 - DNA, 7018 bp, Homo sapiens
agtcccgcctctaccgcccagcggacgccgccgccgccgccgccgccgcgtacctagccaggtccctgaggggcgggcagatgaggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctgaaactggcccaccctggtgctagttccttccggatactgagaactcagcacctggactctaatgggacccactttttccacctggggtccaatgtcgtggacagtgagagtcgggctttcagctatagcattaatttatttgttcagaatacattggcagctgctagtggtttccctggaagtggcagcagcagtgagcagtcagcagatggatgatcagttgagtttagctggagtggggagcaggagccccaggaacaggggtgttggctgagccccattctgggtcaggccctccccctttgcagggcagccgagggtcagatttttgcaccaaggagaactggcaggttcctgcctcctgacgtacctcacacccagccgggaagtcgatgggatgctgggacctggggaaccaaggataggggaaggagtcagcacagtgaaaggctgcctttatccctgcccacatgttccctctctcacagttttccccccacagagcccctttcagtggccccttggtcctcctaactaagctgtcacctaccatatgtgggcctttttgttttataacaggagtattttctctccaggtccaccccaacctcccctgatttatagcctgaagccttatctttcacactagtgttggtcccttcaggtttggcccatcttgtattgctcttctgttcattcttacatcacagcaatctagtcactccctggtcatccctcagtcactcatatcagagtcattctctctggccatctttggtcactcacgtgtcacagcagcccacgccaacaggatgcagacaggtgcaatggaaacagtccttgcggagccaagactcacccagggtaaaatatttcccctcatagtgacagggggctagggaagaacgggaaatgttagtaggtgtaggagtgctgatgagaggcagaggctcttctggtctggggtggagacagtaagtacgcactatccccgtatttagtttgtctttcctgtttcacagctggaggaagcctgggtattttgacacgggatcatctgtaaggccccatcctccctgtgccctctctgctgctcctccattcctaacgcttcaccccactttaccttgagcttggaagtagcacttgctgtagactcctgggtgctggaggagtagagacatcaccaagcagatgatcccccagcctcctaggatccccttggcctgtccagcccagagcatccttagggccattgctgctgcacagccctctcagacccttcttggcctctgctcagctactctggtcttgactccttgactttgctttgcgttgctccttgagtcttagtttctgtctttctcccctgggctcctgtctcacactatctccctgccctctgctctcacaggctggggatgtttataaagtgaggaccctggccccctgctgagtagagctggaaaagttgtaactctgtttcctgaggtgagggcatgaaaacaagaggtctagctttaacaagctgtgagagctgattcatgccccggcacagctagagggagggaggtggccatggagggggcactggactgggcacttccccagcaaggaggcaggaggggcgagggcccccaggtggtccccagatctcttccctgacctggagagaaggaagcattccaccttccccctttctcccccactgccaccaccaggggtgtgtatgctgggatccctgcctggaccggagggaggcatttcctggggatggttaatcctgtgccccagccaaacccaggagctgcaatagggtgcgacggccagaagctccaggagagtgagcaggcacctggagtggagactgtgtttccctcagatcctagggcagggtttccctaatgtatccaagaaatagggctgcccctcagagatggtggggagggtctcttttcctcaggcattccagaggtgaactgtccattgcttatcaccttcaaacatacagcagatgtgggatcaccccacatctggggatggttctttcccctttcaaagaggagcatctctaagtgccctgatgggatgaatcactccaggttcacagaggtgtcctctctttcctcccatatataatggagtgaggtttttaggaatttatcatttggcatcctctgagtttcccacaggttctggaggagcccaggatggattattgagagcatgggctgtagagacagtcttcttggattcagatcctgactccacttagctatgtaacctggtcagattacttcacctctctgagcctgtttcctcatctataaattggggatagtaatgccaactcattgggctgttatgaggattactgagataatgcgtgcagtgctcttatcaccatctctggtgcgtaagcgtcaggaaatagcagttgctgtgattggggctaaagctctgaggcaaaatgggcgacattattttctttgaatgacattaagcagtttgtgcatagctgagggcttctattggggatggctgtctcctggcatagacctctgcacctttcacactcatactccttgtcagcagtccccaacctttttggtaccagggaccggttttgtggaaaacaatttttccaccagtggatggagggggatagcagcggggagatgattttgggatgaaactgtttcatctcagatcatcaggcattagattctcataaggagtgtgcaatctagatcccttgcatgcggagttcacagtggggtttgcactcctgtgagaatctaatgcctctgctgatctgccaggaggaggagctcaggcggtaatgctcactcgcctgccgcccacctcctgctttgtgctcccgcttcctaacaggccacagactggtactggcctgtggcctgggggatggagacccctaatccatgtcacctttcccacctctttcaaaaacaggtacctccaggaacattttggttttggcccttgtattgacttctgaatgtctagtttgagaaactgttcccaataagccttcttcccccagatctgcaccctcgcctctaccctaggacaagatgtccttttctcatcatcctgccaggctaactttaagtctcctgctttttctcacttggatttggatccatttcttcctatttccgctcatgtgaactctccagttctcctttctcaccactctcctgctagccatctctttggcactaaaggccctggtcaaattggatttctttcatttttccacacttcaaagacccatgttctaggtattctccatagggatagtctctttggcatttatttggtttttctacgttttcagtcccatttactccaagactcactccctgccacctagtgcatcagatacagctacttctggctgacttttcaagggggaccaccctacctgtcatctcttcactgttcagaaatgactgtgtcagtgcacctcaaactcccttgctgtccttttccaaggagacagctaaggtggatggagatgcagaatggacctcacgttcgccctagtcaggactgataccctttccgtttcagaggattgccaagaaaaaactcacagttgaggcagggtgctctgaggtcggctgcggtgtgggaggcacggcctgggcctgctctctgggctggagcaggtggattcgaaggcctgtctagcacgagggcccaaaggtcttgtcagtggccagtagctctgccgcctttcccagagagggggtccaggggacatcctggaaggctgggccctgggccaccttctgctcttgcaagctagagccagcccaatagggggcggatgtgagtggggagctggggcgcatgaaggtgggggtgatgccgaaggggaagggatcgccagtggggattggtgcgtgtgcggaaacggggacagaagtgaaggttcatcgcctataacgaagatgaggtaggcatataggggcttctggaaagctagaggctgggctgagccaggagtcctctcccagaagttggggggcggtgcagaggtgtgggtcgagcccgcatgcgtgcctgctggggagggggtgagtggtgaggaccaggcccgctgggtcctgggggcgcggtggctggcgcgcaggtcccggagggggcggctggcgcgcactacacgcttgggaacaaggaaaacatccgccggaggcccggccgggcggcgctccagcctcggggcaggtgcgcggagaggaagtgagagcattccggcccccccaccccaaccccggccgctggccctctggtgagtcacagccgacccccgccgccggagggagaggggagctgcgggccagagccccggagggtctggaggagccaggagggtttctgggagcagagggtcacttagtgggcttctgtcgtggtgtcgctacgggcgcgaaacggacactgaacacagtctgactgtatggaggcaggtggggagggatcccctgggagaacttggcgggccgagagcagaccccagggcaaggaggggcccccgagggggaaaccgggagtcgggcaggtggcgtaacccagaaagggaaggagagccggattgattggggtgagagaggaaggaagcacgccaagttaggcctgggagaactgagggacctgaggagggaggagggagaccaacacagggtgggaaggcggaaatggccaaaccccaggcatcaggtctgtccagaggctgacgtagacagtgaagggtgaagggtaggttttaggagtagggggagttatgattatttggttacattttgggattatttggtctcacaggtagaagggagcctgctggtctctgtgtaacggatggcttaaaagcaaggttgtctgcgtcttggattactgtctgccattcagcctttgccaaaaaatttggcactgatctgcacatttttatagtcatttaaaattgtatgactctgtcaaatgatttaagtaattttggtggatttttaaaaataaaaaaataaaaatagaaaagttgcacaatctaattcaatatttgacttaaaaccaaaagtgaggctctcagattggtaatatggtattcagcctttttcttgtttggcttttgtgccatttgcccctcactgacttgattgaattctttgtggctgatgcctcagtttttctggatcagtagtgctgcacttccacttttcctctccctcattttactgtctttatttttagccttttttctgtgtagccctctaacctgccctttatattttgaaccaaataaaacatttcttggaatgggagctttggactacagtatacagacaaacaactcacaattttagcatatgaggctactatcttctgtggatgtgtatgtaattatacagtttctgtatttatcctgtggctgatagaaaaagttaaagctgtttaattcaccatagtatttctacaacacagcaatttattagtctgacttctcttctaaaatcaactctaaaatggtattttgtacttgtctcagagacgaattctgccatgatccttatgatctgtgttatgttgggccaaaggtgattactttataaattataaagatccctaaactctgcattgcctttggtcccaaacaagcaaatctgggtcaattaatg

SEQ ID NO: 26172 - DNA, 1296 bp, Homo sapiens
atgacccgagccctttccggtctggcctgccgggcgcttccggccggaagggactccgcggagggcctaggggtgccgatccctagtgtcgactatgcgagatctgattccggagctgccatgattgaagtggtagcagagctcagccggggtcctgtatttttggctggggaggcgctggagtgtgtagtgaccgtcaccaacccccttccgcccacggccacttctgcatccagtgaggccctggcctgggccagtgcccaaatccactgccagttccatgccagtgagagtcgagtagcactgcctcctcctgactctagtcagccagatgtccagcccgacagccagactgtctttctgccacaccgaggtgagaggggccagtgtatcctttctactccaccgaaaattctattctgtgacctgaggcttgatcctggagagtccaaatcatactcctacagtgaagtgctgcccatagagggaccaccctcctttcggggtcagtcagtcaagtacgtctacaaactgaccattggctgccagcgtgtcaactcccctatcactttactcagagtccctctgagggttcttgtgctgactggccttcaggatgtccggtttccccaggatgaggctgtagccccatccagtccattcttggaggaggatgaaggtgggaagaaagattcatggctagctgagctggctggggaacgcctaatggctgccacatcctgccgcagcctccatctatacaatatcagtgatggccgagggaaagttgggacgtttggcatcttcaaatctgtgtacagacttggcgaggacgtggtggggaccttaaacttaggggaaggaaccgtagcttgtttgcagttttcagtcagcttacagaccgaggagcgtgtacagcctgagtaccagcggcgacgtggggcagggggtgtcccctctgtgtcacatgtgactcacgcccggcaccaggaatcctgcctacatacaactagaaccagcttctccctcccaatccctctcagctccaccccaggcttctgtacagccattgtgtccttgaagtggagattgcattttgaatttgtaacgtcccgagaaccaggattggtactcctaccccctgtggaacagcccgaacctaccacctggacaggacctgagcaagtacctgtagacaccttcagctgggacctgcccatcaaggtgctgcctactagccccaccctggcctcatatgctgccccaggccccagcaccagcaccataaccatctga

SEQ ID NO: 26173 - DNA, 1537 bp, Homo sapiens
atcgctccctcaagccctcaagtaggtgttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttt

SEQ ID NO: 26174 - DNA, 1477 bp, Homo sapiens
gttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaa

SEQ ID NO: 26175 - DNA, 1087 bp, Homo sapiens
ggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattagga

SEQ ID NO: 26176 - DNA, 971 bp, Homo sapiens
cacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacgtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaa

SEQ ID NO: 26177 - DNA, 1810 bp, Homo sapiens
atgcccggggcgtgtgcggcggtgcggcccgggctccacgtccacaggctgggcagcgctgtgggccccgcgggcgccgagtccgcaggacccgcgagggcactaccgcgaagcatcggcctccgggccgggccgggccggaccgggagcctgctcggcgggtccgggctcctgcaaggcggggacgcggggccggcgacccttcacgcttcgtactcattgagcgccgattttatgccaggcaccgtgctggatctcccagtgcctggaagagaaaacccattctgtttcgaagggcatccagagctggtcacagtggggacccaccctccttttccaggctacgccagaccctgggtgtgtgtacgtttcaatggaagtgaatttaaatgtactttataaatcaaagactttttctgagactttggagagttccagtaatgagagcttctcattgttatcaaagccagggctggagaccagtggcagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcatt

SEQ ID NO: 26178 - DNA, 1235 bp, Homo sapiens
gcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagca

SEQ ID NO: 26179 - DNA, 1483 bp, Homo sapiens
atgtactttataaatcaaagactttttctgagactttggagagttccagtaatgagagcttctcattgttatcaaagccagggctggagaccagtggcagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttt

SEQ ID NO: 26180 - DNA, 1463 bp, Homo sapiens
atcgctccctcaagccctcaagtaggtgttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcattttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttt

SEQ ID NO: 26181 - DNA, 1345 bp, Homo sapiens
atcgctccctcaagccctcaagtaggtgttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatggattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttt

SEQ ID NO: 26182 - DNA, 1411 bp, Homo sapiens
atgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacagactaccacatgaacctgaggcacttctacgtgttcgcagcctattttgggctgactgtggcctggtgcctgccaaagcctctacccaagggaacggaggataatgatcagagagcaacgatacccagtttgtctgccatgctgggcgccctcttcttgtggatgttctggccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagact

SEQ ID NO: 26183 - DNA, 1302 bp, Homo sapiens
atcgctccctcaagccctcaagtaggtgttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacacttatgtgcacagtgcggtgttggcaggaggcgtggctgtgggtacctcgtgtcacctgatcccttctccgtggcttgccatggtgctgggtcttgtggctgggctgatctccatcgggggagccaagtgcctgccggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttt

SEQ ID NO: 26184 - DNA, 1404 bp, Homo sapiens
atcgctccctcaagccctcaagtaggtgttggagagaggggtgatgcctggtgctggtggaacccctgcacagagacggacacaggatgagctctaagtacccgcggtctgtccggcgctgcctgcccctctgcgccctaacactggaagcagctctcattctcctcttctatttttttacccactatgacgcttccttagaggatcaaaaggggctcgtggcatcctatcaagtcggccaagatctgaccgtgatggcggcccttggcttgggcttcctcacctcaaatttccggagacacagctggagcagtgtggccttcaacctcttcatgctggcgcttggtgtgcagtgggcaatcctgctggacggcttcctgagccagttccctcctgggaaggtggtcatcacactgttcagtattcggctggccaccatgagtgctatgtcggtgctgatctcagcgggtgctgtcttggggaaggtcaacttggcgcagttggtggtgatggtgctggtggaggtgacagctttaggcaccctgaggatggtcatcagtaatatcttcaacccaagtgtcaactctgctctgctgagaagtccaatccaaaggaagaatgccatgttcaacacctactatgctctagcagtcagtgtggtgacagccatctcagggtcatccttggctcacccccaaaggaagatcagcatgacttatgtgcacagtgcggtgttggcaggaggcgtggctgtgggtacctcgtgtcacctgatcccttctccgtggcttgccatggtgctgggtcttgtggtgtgttgtaaccgagtgctggggattcaccacatctccgtcatgcactccatcttcagcttgctgggtctgcttggagagatcacctacattgtgctgctggtgcttcatactgtctggaacggcaatggcatgattggcttccaggtcctcctcagcattggggaactcagcttggccatcgtgatagctctcacgtctggtctcctgacaggtttgctcctaaatctcaaaatatggaaagcacctcatgtggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccttatgtataatgaaacaaggtcagagacagatttgatattaaaaaattaaagactaaaaacttagtttaagagtcaatttaataagtttaaaataaatgtttagtttcattaggatgatgctatcaatattttcttggttacagacacattattaaagttttgggttaatttt

SEQ ID NO: 26185 - DNA, 2833 bp, Homo sapiens
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgattggcttccaggtcctcctcagcattggggaactcagcttggccatcgtgatagctctcatgtctggtctcctgacaggtttgctcctaaatcttaaaatatggaaagcacctcatgaggctaaatattttgatgaccaagttttctggaagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttgagatgtagtcttactctgtcacccaggctagagtgcaatggcaccatcttggctcactgcaacctctacctcctgggttcaagcaaatctcctgcctcagcctccaaagtagctgggattacaggcacccaccacatctggctaattttttgtatttttagtaaagatggggtttcaccatgttggccaggctgatctcaaactcctgacctcaagtgatctgcccgcctcggcctcccaaagtgctggaaccacaggcctgagccactgtgcccagccttgtttgcttttttaacagataacagtgtgctcatagaaactgctttgacatgactgcaatcatgtgcttcatagaaacttaattagattataccactagagtcttcagatttttatactttttttttttgaaacggagtctcactctgtcaccaggctggagtgcagtgccgcaatctcggctcactgcaacctccgcctcccaggttcaagcaattctcctgcctcagcctcccgagtagctggaattacaagtgcgcactaccacacccagctaatttttgcatttttacttgacagggtttcaccatgttggctaggatagtttcaccaggatctcttggcctcatgatcagcctgcctcggcctcccaaagtgctgggattacaggtgtgagccaccgtgcccagcctatacttccctttttgaataccatttggtgttttgaagaattaacagctttgtgaacgtggcagtgcttgtgattcaggcttccattgagaccaaggggagaacctggttgcaggacaaacagacggacagcgtgtggcagtgtttaaatgctcttctgaaggctgatacgacagctctctgtgcactgattgcatatgcatcccaagattatattattgttttctactgctatgtgtcacactttgccaaacaggatgtggaaaatgaataagcggttttcttaggcacttcttaacagacaattggtcaaaatgaactccattgcttaagaaacacataaacaccatttagtcactgaacatagctatatgtatggttgttactatgggaaatcttgttttgccaattttctttgaaaattctggcagaccaaggttctttttgtttacataatacttgaaaaataaaaatgaacaagctaacaaacta

SEQ ID NO: 26186 - DNA, 1557 bp, Homo sapiens
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgtcactcggctggaacctggctgtaaaaatggctgaagcaggtgatgaggagctgatgcgtttggacgtgtctcagagaaatcatggaggcgctgcggttcctaccggttcttggatgccttctacagagacaaccatagccccaaattatagggatcacatatcagtggtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 26187 - DNA, 1387 bp, Homo sapiens
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcattttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 26188 - DNA, 1333 bp, Homo sapiens
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggattggcttccaggtcctcctcagcattggggaactcagcttggccatcgtgatagctctcatgtctggtctcctgacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 26189 - DNA, 2831 bp, Homo sapiens
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgattggcttccaggtcctcctcagcattggggaactcagcttggccatcgtgatagctctcatgtctggtctcctgacaggtttgctcctaaatcttaaaatatggaaagcacctcatgaggctaaatattttgatgaccaagttttctggaagtttcctcatttggctgttggatttagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttgagatgtagtcttactctgtcacccaggctagagtgcaatggcaccatcttggctcactgcaacctctacctcctgggttcaagcaaatctcctgcctcagcctccaaagtagctgggattacaggcacccaccacatctggctaattttttgtatttttagtaaagatggggtttcaccatgttggccaggctgatctcaaactcctgacctcaagtgatctgcccgcctcggcctcccaaagtgctggaaccacaggcctgagccactgtgcccagccttgtttgcttttttaacagataacagtgtgctcatagaaactgctttgacatgactgcaatcatgtgcttcatagaaacttaattagattataccactagagtcttcagatttttatactttttttttttgaaacggagtctcactctgtcaccaggctggagtgcagtgccgcaatctcggctcactgcaacctccgcctcccaggttcaagcaattctcctgcctcagcctcccgagtagctggaattacaagtgcgcactaccacacccagctaatttttgcatttttacttgacagggtttcaccatgttggctaggatagtttcaccaggatctcttggcctcatgatcagcctgcctcggcctcccaaagtgctgggattacaggtgtgagccaccgtgcccagcctatacttccctttttgaataccatttggtgttttgaagaattaacagctttgtgaacgtggcagtgcttgtgattcaggcttccattgagaccaaggggagaacctggttgcaggacaaacagacggacagcgtgtggcagtgtttaaatgctcttctgaaggctgatacgacagctctctgtgcactgattgcatatgcatcccaagattatattattgttttctactgctatgtgtcacactttgccaaacaggatgtggaaaatgaataagcggttttcttaggcacttcttaacagacaattggtcaaaatgaactccattgcttaagaaacacataaacaccatttagtcactgaacatagctatatgtatggttgttactatgggaaatcttgttttgccaattttctttgaaaattctggcagaccaaggttctttttgtttacataatacttgaaaaataaaaatgaacaagctaacaaacta

SEQ ID NO: 26190 - DNA, 1637 bp, Homo sapiens
atgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccggggtgttgtaaccgagtgctggggattccccacagctccatcatgggctacaacttcagcttgctgggtctgcttggagagatcatctacattgtgctgctggtgcttgataccgtcggagccggcaatggcatgtcactcggctggaacctggctgtaaaaatggctgaagcaggtgatgaggagctgatgcgtttggacgtgtctcagagaaatcatggaggcgctgcggttcctaccggttcttggatgccttctacagagacaaccatagccccaaattatagggatcacatatcagtgggattggcttccaggtcctcctcagcattggggaactcagcttggccatcgtgatagctctcatgtctggtctcctgacagtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagc

SEQ ID NO: 26191 - DNA, 2545 bp, Homo sapiens
ttggagagaggggtgatgcctggtgctggtggaacccctgcacagagacggacacaggatgagctctaagtacccgcggtctgtccggcgctgcctgcccctctgggccctaacactggaagcagctctcattctcctcttctatttttttacccactatgacgcttccttagaggatcaaaaggggctcgtggcatcctatcaagttggccaagatctgaccgtgatggcggccattggcttgggcttcctcacctcgagtttccggagacacagctggagcagtgtggccttcaacctcttcatgctggcgcttggtgtgcagtgggcaatcctgctggacggcttcctgagccagttcccttctgggaaggtggtcatcacactgttcagtattcggctggccaccatgagtgctttgtcggtgctgatctcagtggatgctgtcttggggaaggtcaacttggcgcagttggtggtgatggtgctggtggaggtgacagctttaggcaacctgaggatggtcatcagtaatatcttcaacacagactaccacatgaacatgatgcacatctacgtgttcgcagcctattttgggctgtctgtggcctggtgcctgccaaagcctctacccgagggaacggaggataaagatcagacagcaacgatacccagtttgtctgccatgctgggcgccctcttcttgtggatgttctggccaagtttcaactctgctctgctgagaagtccaatcgaaaggaagaatgccgtgttcaacacctactatgctgtagcagtcagcgtggtgacagccatctcagggtcatccttggctcacccccaagggaagatcagcaagacttatgtgcacagtgcggtgttggcaggaggcgtggctgtgggtacctcgtgtcacctgatcccttctccgtggcttgccatggtgctgggtcttgtggctgggctgatctccgtcgggggagccaagtacctgccgtttcctcatttggctgttggattttaagcaaaagcatccaagaaaaacaaggcctgttcaaaaacaagacaacttcctctcactgttgcctgcatttgtacgtgagaaacgctcatgacagcaaagtctccaatgttcgcgcaggcactggagtcagagaaaatggagttgaatcctttctctgccactctttgaggagaatctcaccatttattatgcactgtagaatacaacaataaaatacagccatgtaccacataacaacatcttggtaaacaacagactgcatatatgatggtggtcatccagtaagctaaggttaatttattattattccttgtttttttttttttttttttttttttgagatgtagtcttactctgtcacccaggctagagtgcaatggcaccatcttggctcactgcaacctctacctcctgggttcaagcaaatctcctgcctcagcctccaaagtagctgggattacaggcacccaccacatctggctaattttttgtatttttagtaaagatggggtttcaccatgttggccaggctgatctcaaactcctgacctcaagtgatctgcccgcctcggcctcccaaagtgctggaaccacaggcctgagccactgtgcccagccttgtttgcttttttaacagataacagtgtgctcatagaaactgctttgacatgactgcaatcatgtgcttcatagaaacttaattagattataccactagagtcttcagatttttatactttttttttttgaaacggagtctcactctgtcaccaggctggagtgcagtgccgcaatctcggctcactgcaacctccgcctcccaggttcaagcaattctcctgcctcagcctcccgagtagctggaattacaagtgcgcactaccacacccagctaatttttgcatttttacttgacagggtttcaccatgttggctaggatagtttcaccaggatctcttggcctcatgatcagcctgcctcggcctcccaaagtgctgggattacaggtgtgagccaccgtgcccagcctatacttccctttttgaataccatttggtgttttgaagaattaacagctttgtgaacgtggcagtgcttgtgattcaggcttccattgagaccaaggggagaacctggttgcaggacaaacagacggacagcgtgtggcagtgtttaaatgctcttctgaaggctgatacgacagctctctgtgcactgattgcatatgcatcccaagattatattattgttttctactgctatgtgtcacactttgccaaacaggatgtggaaaatgaataagcggttttcttaggcacttcttaacagacaattggtcaaaatgaactccattgcttaagaaacacataaacaccatttagtcactgaacatagctatatgtatggttgttactatgggaaatcttgttttgccaattttctttgaaaattctggcagaccaaggttctttttgtttacataatacttgaaaaataaaaatgaacaagctaacaaacta

SEQ ID NO: 26192 - DNA, 1913 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 26193 - DNA, 1863 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 26194 - DNA, 1911 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctct

SEQ ID NO: 26195 - DNA, 1784 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggaccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctct

SEQ ID NO: 26196 - DNA, 1790 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaa

SEQ ID NO: 26197 - DNA, 2022 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactccccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctct

SEQ ID NO: 26198 - DNA, 1493 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagtctggggagggatggagtcgggggtggggggtggtcaaggtcagcctctgagccaggagcgtgggggtgggggcggggtgctgcctctcaccccacctccccaggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggaggcatcatattggtcttatgcctcctagacccctgtgccctgtggcactgggtggcaccctcctccatggtggggggcagagaagcctcacagatcctcccctaccaccaccagggctcctgctga

SEQ ID NO: 26199 - DNA, 1197 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctgggcccatccttgaatcaaaattcaaagtccaagacacatgtggagtccacaacctccatgggatgccgggggtcctgggggccctcctgggggtccttgtggctggacttgccacccatgaagcttacggagatgggtgagtttcctcccaacccgtactgcagtcgtcatccatctggaatgacctctgtcattctctttcactgtgtgtgaccaagaaaaaagaatgaattcattcattcatccatattctgggagcaaaggaaattggagttaacaaaaccaacccagaaactgccttcctggtcctctatcaagtgcagcagaaggtcatggaacaaatgacttcaagagtgttacttgttactgaagggtcagtaagagataatgacctttaggatctatttttgcacatcaagggtgggcaaaagcaacccgcaaatggagtcttaaaaggtgcctaggtgtctgctggcctacaagggtgggaaggtgttccaggctgtgggcctggcttgagcagtggcctggaggtgagactcagcctggcatgcaccctcgagaccctcttggccacttcctgttccccagtgtgagttccagtgccatgagcagccctggccccgggctgcatccctctctctccctacccctgcctttcctctatctggtctccctgcagcct

SEQ ID NO: 26200 - DNA, 1982 bp, Homo sapiens
ctcaaaagccccgccggcctccgagcgtccgaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgtaaaa

SEQ ID NO: 26201 - DNA, 1882 bp, Homo sapiens
atggcctggaacacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcaggctccacagactgtcctggggcccagaggagctggtgctgacctagctagggatgcaagagtgagcaagcagcacccccacctgctggcttggcctcaaggtgcctccacccctgccctccccttcatcccagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggcagcctccaggaataaacattcttgttgtcctttgt

SEQ ID NO: 26202 - DNA, 1748 bp, Homo sapiens
gaaccgcccgctgccagcccggccaggcacccctgcagcatggcctggaacaccaacctccgctggcggctgccgctcacctgcctgctcctgcaggtgattatggtgattctcttcggggtgttcgtgcgctacgacttcgaggccgacgcccactggtggtcagagaggacgcacaagaacttgagcgacatggagaacgaattctactatcgctacccaagcttccaggacgtgcacgtgatggtcttcgtgggcttcggcttcctcatgactttcctgcagcgctacggcttcagcgccgtgggcttcaacttcctgttggcagccttcggcatccagtgggcgctgctcatgcagggctggttccacttcttacaagaccgctacatcgtcgtgggcgtggagaacctcatcaacgctgacttctgcgtggcctctgtctgcgtggcctttggggcagttctgggtaaagtcagccccattcagctgctcatcatgactttcttccaagtgaccctcttcgctgtgaatgagttcattctccttaacctgctaaaggtgaaggatgcaggaggctccatgaccatccacacatttggcgcctactttgggctcacagtgacccggatcctctaccgacgcaacctagagcagagcaaggagagacagaattctgtgtaccagtcggacctctttgccatgattggcaccctcttcctgtggatgtactggcccagcttcaactcagccatatcctaccatggggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggaggacctggaacttgctcctaatcaatagaatacagcaaaggcatgggatgcaggtgattctgtgtacatggttacgtaactaaatagataagattgtagcacctgtcttgctggagtgtttcacactcttgctggctttgatgaagcaggtggccatttgaggcccaactgagagtggcctgtaaaactgagggcagctgacagccagcaagaaaatgagccttcagtcctgtaaatgcaaggaactgaattgtgccaagagctgcatgagcttggaagcagatccttcctcagtcaagcttccagatgaggacccagtcctgacccatactttgattgcaggcttgcagagggcccagctcagccattccaagattcttgacccacagaagctgagag

SEQ ID NO: 26203 - DNA, 1014 bp, Homo sapiens
ggacagccagcaccgagccgccatcaacacctactgctccttggcagcctgcgtgcttacctcggtggcaatatccagtgccctgcacaagaagggcaagctggacatggtgcacatccagaatgccacgctcgcaggaggggtggccgtgggtaccgctgctgagatgatgctcatgccttacggtgccctcatcatcggcttcgtctgcggcatcatctccaccctgggttttgtatacctgaccccattcctggagtcccggctgcacatccaggacacatgtggcattaacaatctgcatggcattcctggcatcataggcggcatcgtgggtgctgtgacagcggcctccgccagccttgaagtctatggaaaagaagggcttgtccattcctttgactttcaaggtttcaacggggactggaccgcaagaacacagggaaagttccagatttatggtctcttggtgaccctggccatggccctgatgggtggcatcattgtggggctcattttgagattaccattctggggacaaccttcagatgagaactgctttgaggatgcggtctactgggagatgcctgaagggaacagcactgtctacatccctgaggaccccaccttcaagccctcaggaccctcagtaccctcagtacccatggtgtccccactacccatggcttcctcggtacccttggtaccctaggctcccagggcaggtgaggagcagggggtctgactgagaatggagaaggagaagctacaaagtgggcatccaagccgggttctggctgcagaagttctgcctctgcctggggtcttggccacattggagaaaaacaggctcaaagtggggctgggacctggtgggtgaacctgagctctcccaggagacaacttagctgccagtcaccacctatgaggctcttctaccccgtgcctgcacctcggccagcatctcctatgctccctgggtcccccagacctctctgtgttgtgtgcgtggca

SEQ ID NO: 26204 - DNA, 1291 bp, Homo sapiens
gtttgcgcctgcgcagtgggtgctgattatgtcgaccgcggcgccgcggacgctgctggagtcgcctggcaacgatgtcgcctggcaactgaataggttggccagtggcgcgggctactggaagcagaaagggctgcggaggcagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccttgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagatacgcctttctagagcacgacatcgtccttgccctgtccttcctgctgaatgaccccagcccagtctgccgggggaacctgtacaaggcatacatgcagctggtccaggtgcctagaggggcccaagagatcatcagcaaaggtctgatttcctcactggtatggaagctgcaggtggaggtggaggaggaggagttccaggagttcatcctggacacactggtcctctgcctgcaggaggatgccaccgaggccctgggcagcaatgtggtgcttgtcctgaagcagaagctcctcagcgccaaccagaacatccgcagcaaggccgcccgtgcgctccttaatgtcagcatatctcgagagggcaagaaacaggtgtgtcattttgacgtcatccccatcctggtccatctgctgaaagacccagtggagcatgtgaagtctaacgctgccggtgccctgatgttcgccacagtgatcactgaagggaagtatgcggccctggaggcacaagccatcggcctgctcctggagctgctgcactcccccatgaccatagcgcgcctgaatgccaccaaggcccttaccatgctggcagaggcccccgagggccgcaaggccctgcagacgcacgtgcccactttccgtgccatggaggtggagacttacgaaaagcctcaagtggccgaagccttacagcgggcagcccggatcgccatcagtgtcatcgagttcaaaccctgagcccttcattcacctctgtgagtgaataaatgtgctaagtctcttta

SEQ ID NO: 26205 - DNA, 1225 bp, Homo sapiens
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccat

SEQ ID NO: 26206 - DNA, 1912 bp, Homo sapiens
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaacatcagtctttgactct

SEQ ID NO: 26207 - DNA, 1283 bp, Homo sapiens
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagagtctaaacaccattcctgctctccagctt

SEQ ID NO: 26208 - DNA, 1203 bp, Homo sapiens
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtaaacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggaacctgaagtctaaacaccattcctgctctccagctt

SEQ ID NO: 26209 - DNA, 1256 bp, Homo sapiens
ccagggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctga

SEQ ID NO: 26210 - DNA, 463 bp, Homo sapiens
tcagaagggctctgagaacacgcaccgggagtgcctggaggggtttcctgcaaagtaggagcaggcacctggccaggcttggaagaaaaagactgtagatccaaaatgatacgaaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcactt

SEQ ID NO: 26211 - DNA, 859 bp, Homo sapiens
aactgccagtactcagaagtcagagttgagagacagaggcaccccggacagagacgtgaagcactgaataggatgaaactggggcccagtgaggttaagcaacttgcaggaggtaacgcaggaaccgagttgcgctgaaacatcgttatctgacacttccctgctttgttaaagctgtctctgcagagcttgcaaagaagcatttacctctgcttgtgcacctccagaaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccct

SEQ ID NO: 26212 - DNA, 911 bp, Homo sapiens
ggctggctggatttggaggactgtgataactcctacagctttttgactgggcttttgcttcatttgttcaggagtctttgtgccatgttgcttcactcgtaaaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacc

SEQ ID NO: 26213 - DNA, 354 bp, Homo sapiens
gctgctcaagttggctgatcaagagataggcagtgcaaaggaacaggatttgagacagcccagggtttcctcttcaaaaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactg

SEQ ID NO: 26214 - DNA, 723 bp, Homo sapiens
cattatcactcagactgtgcatgctgcaagctttgacgctagccaggctggctggatttggaggactgtgataactcctacagctttttgactgggcttttgcttcatttgttcaggagtctttgtgccatgttgcttcactcgtagtacgttattcacatatgagtgatttctttcttgtcagttttgttcagtgaatagaagatactacaatggtacagagaaattcaggcagaaatagatcagaatgactgaaaaagccccagagccacatgtggaggaggatgatgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagt

SEQ ID NO: 26215 - DNA, 3375 bp, Homo sapiens
gtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaaaaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatcaacaccttcaccaagttccttctggatcaccaaggggagctgttcccaagcccggaccccagcgggctctgaacctggcccctgccccaccagccccttctctggtagcccgggtttggactcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcacccggccagccctgttgtctttcaaagaacctcggccccagtgatggctgatctcactcccactgtctcgtagaattacactccttcctggggatccctcttcctgcagccttgtccttggggagtacagggaagtacctgcagtgaccctgcccccatgaccttggccaggcaggatgattccagagcccgtactgtggggatcctcactgaccagcccagccccatccgcaagccaggctgggcctgggcataacttcgctgggctctcccaagaccatcagcagtgcatccagccccctggggcctgggctgctgctggttcttcatcagtcccttggtctctagcctcggccagggctgctctgctctccgccctcctttgtgtatcaagtgtcgctcacagccccattcactggggagcctttcggatctatttggtctttctcatgtcccccactggtctgtaccccagggagcgggtgcttgtactgtgtgaatccagtgttcacattcacacttaatgacttccttggcaccaatcatgtatttcaccgtttgcactttttgtatttcaataaaaatgttgatgcaaaa

SEQ ID NO: 26216 - DNA, 1667 bp, Homo sapiens
cgcggagccggatgtttgccgagccttgacaggcgtggcagagggagcagtgcccgagcgcggtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaaaaacatcaaggccttgtacatcgtgcatccaaccatgttcatcaaaactctgctcatcctcttcaagcccctcatcagcttcaagttcgggcagaagatcttctatgtgaattacctgagcgagctgagcgagcacgtgaagctggagcagctggggatccctcgccaagtgctcaaatatgacgacttcctgaaatccacacagaagagccccgcgacagcccccaagcccatgcccccacggccccccctgcccaaccagcagtttggagtctcgctgcagcacctccaggagaagaatccagagcaggagcccattcccattgtactcagggagactgttgcctacttacaggcccacgctctcaccaccgagggcatcttccggaggtcggccaacacccaagtggtccgggaagtgcagcagaagtacaacatggggctgcctgtggatttcgaccagtacaatgagctgcacctgccagcagtcatcctcaagaccttcctccgggagcttcctgagcccctgctcacctttgacctctacccccatgtggtgggcttcctcaacattgatgaaagccagagggtgccagcgacactgcaggtcctccagacgctgcccgaggagaactaccaggtgcttcgtttcctgactgctttcctggtgcagatttctgcacacagtgaccagaacaagatgaccaacactaacctggctgttgttttcggccctaacctgctgtgggccaaggatgcggccatcaccctcaaggccattaatcccatggccacctttttttttttttttctgagatggagtctcgctctgtcaccaggctggagtgcagtggcgcgatctcggcacacctccgccttctgggttcaagcaattctcctgcctcagcctcctgagtagctgggactataggtgcatgccaccatgcccagctaatttttgtatttttagtagagacggggtttcaccatgttggccaggatggtctcgatctcctgacctcatgatccacccacctcggcctcccaaagtgctgggattccaggcgtgagccactgcacccggccagccctgttgtc

SEQ ID NO: 26217 - DNA, 890 bp, Homo sapiens
gttgctgcccattagggctgagggcagaggtgcctacccccaggctgcatgcggctgcagccttctggccagattccagacctacagaaacccagcttggtggtcgagtctgccttgtgcctgccggagctgctgttctgctggtgacctcctcatctcagcaccccagacatcacgagcatccccctttcccatctgcgccctccaatccttagggccgtcaacctttccaccttgaaactggtgtcaggagcaccctgcagagtttctcttaaggttctgcagggcaaggctgtctgggacaggcttggccatggatccgctctcagagctgcaggatgatctgaccttggatgacaccagcgaggctctgaaccagctgaagctggcctccatcgatgagaagaactggccctcggatgaaatgcctgacttccccaagtcagatgactccaaaagcagctccccggaacttgtcacacacctgaagtgggatgacccatactatgacatcgcccggcaccagatcgtggaggtggcaggagatgacaagtatgggcggaagatcattgtgtttagtgcctgtcgaatgccccccagccaccagctcgaccacagcaagctcctggggtacctgaagcacaccctggaccagtacgtggagagtgactacacacttctgtatctgcaccacggcctgaccagcgacaacaagccctccctcagctggctccgtgatgcctaccgggagtttgaccgcaagtacaagaaaaacatcaaggccttgtacatcgtgcatccaaccatgttcatcaaaactctgctcatcctcttcaagcccctcatcagcttcaagttcgggcagaagatcttctatgtgaattacctga

SEQ ID NO: 26218 - DNA, 3299 bp, Homo sapiens
gagctcggcgggggctgccgggattggggcgccgcagctagcgctggtctcggtggcagctcctccgcgccgcaggactcggctctacgggacatgtccgtgccgcgctcgccgcgcgcccgggcctgctagctcctctgtgctccctgaacgcgcggcgccgcacctggcagcggcctcggagctcggctcgggcaggagcgcgcggccgtgcgcaccgcgcagcgaccgctgccgtcatggggctgcagcccctggagttcagcgactgctacctcgacagcccgtggttccgggagaggatccgcgctcacgaagcggaactcgagaggaccaacaagttcatcaaagagctcattaaggacgggaagaacctcatcgctgcgacgaaaagtctgtcagtggcccagcggaagtttgctcattcactcagagactttaagtttgagtttatcggtgatgctgtgacagatgatgaacgatgcatagatgcttccttacgtgaattttcaaattttttgaagaatctggaggaacagagagaaattatggcattaagtgtaactgaaaccctgattaaacccttggaaaaattcagaaaagagcaacttggagctgtaaaggaagaaaaaaagaagtttgacaaagagacagaaaagaattatagtctaattgataaacatttgaatttatcagcaaaaaagaaagactcacatttacaagaggcagatatccaagtagagcagaaccggcaacacttctatgaactgtctctcgagtatgtgtgtaagctgcaggaaatccaagaaagaaagaagtttgagtttgtggaacctatgctgtcattttttcaggggatgtttaccttctatcatcagggccatgaacttgccaaagacttcaatcactacaaaatggaactacagatcaacattcagaatacacggaatcgatttgaaggaacaaggtcagaagtggaagagctcatgaacaaaatcagacagaatcccaaggaccacaaacgagcaagtcagtttacagccgaaggctacctgtatgtccaggaaaaaaggcctgctccgtttggttccagttgggtcaaacactattgcatgtatcgaaaagcagcaaagaagttcaacatgatcccatttgagcacagatctggagggaaacttggggacggagaggtgttctttttgaaagaatgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaagcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttactatttg

SEQ ID NO: 26219 - DNA, 1934 bp, Homo sapiens
atgtaccaagaggcatactgactccattgacagaaggttttgttttgacatagaagctgctgatcggcctggcgtttccttgaccatgcaggcattttccgaagaggaaaggaagcagtggttggaagctctgggtggaaaggaagctctgtcccatagttttaatacagccatcatcccaagaccagaaggaaatgcacagttggataagatggggttcacaattatcagaaaatgcatcagtgccgttgaaacacgaggtataaatgaccaaggattgtacagagttgtgggggtgagttcaaaggtccagagacttctgagtatgttgatggatgtaaaaacatgcaatgaggtggacctggagaattctgcagattgggaagtgaagacaataacaagtgccttgaaacagtatttgaggagtcttccagagcctctcatgacctatgagttacatggagatttcattgttccagccaaaagcggcagcccagaatctcgtgttaatgcgatccatttcttggtacacaaactgccagagaagaataaagagatgttggatattttggtgaaacacttaacaaatgtttcaaatcactccaagcagaacctgatgactgtggcaaacttaggagtggtgtttggaccaactctgatgaggccacaggaagaaactgtcgctgccctcatggacttgaagtttcagaatattgttgtggaaatcttaattgaaaaccatgaaaagatttttcggacgccgcccgatactacattccctgagcccacctgcctgtcagcatcacccccaaatgcgccaccaaggcagtcgaagagacaaggccagagaaccaagaggcccgtggccgtctacaatctttgtctggagctggaagatggtgacaatccttacccttccaaggaggacacccctaccagcagtctggactcactttcctccccgtctcccgtgactacagctgtccctgggcctcctggaccagacaaaaaccaccttctggcagatggagggagctttggagactgggcatccactatcatccgcagtcggaaggctcgagccgtgtatccgtgtgaagcagaacacagctcggaattatcttttgaaataggagcaatttttgaggatgtacaaacctccagggaacctggctggctagaagggactctgaacggcaagagggggctgattccacagaactacgtcaagctgctgtagctcctggcctcagagcccctgctgaccctggcacccagggacctgcctgggggcagagagctgtcttcctcctccgaggctctgggctgcacccacaggtacctccacacttgggagttaccatcatcacagtcagccctgggggtggggggtggtgggcagggatgggacgcaccacacagaactgtgattgtggatcaggaggggaatgtcaggattcgcaaaatggacttttcatttgtcaagtattgggacttgtgatttttaattatccagcatatagaatgagagggagggcagccttctgccacctgtgtcgcctccactggcagtcacgccaccagagccaccctggctccctctcctccctgagcacctgctgctgcgattttaaagggaactgtactactcgcagtgataggtttgcagagtgtgtgcttggctgtggcagcctagcttggagaagctgctgttggtgcaagggagatggtctcaagtcagagggaagcagagacgcgcgtctcaagcctgcccttcctagacggccacctgcaggaccccacactcactgcactggcagcgtgcactggcgtatttgtaacaggcttctcggtgctcctcacccgtgtgctgttttccaaacaccacctttttgcctcaaggtctctgtaaatgaaataaactgtaatttact

SEQ ID NO: 26220 - DNA, 5898 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgacgttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactaccacatgtgactcctatttttgttagctgaaagctgctatacggagtattacaggaatgtgaaggtgactagcttgaaggtagggtaactagagagccagaaaagttttgttttaaacttgatttaatgcgtttttattttttcttatacaaaatagagataatgttgctaacttcatggaatatttgaggaaatgatatgaaagtgtctggacgtgcagtaacctcatgggttcttctcactgtcttataaatgtaaataaagatctaatattaatttggtta

SEQ ID NO: 26221 - DNA, 3152 bp, Homo sapiens
ggcttcagtgaacgcaccgggatgtgcaggccgggagagcgaaccagacggggacagtaaggtttggaggaagggggatcgttggaagtagcaagaagtggagagaatctggcaatagacgagaaaccgaaagaatcagaaagaagtctatggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgc

SEQ ID NO: 26222 - DNA, 2422 bp, Homo sapiens
agctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggtacatttacatactactgttagagttttacctaaaaatcctgctttagttgcttttttaatggcaaaacatattaattaatttactgttctagagattaaaagttcatgtttgaatagtgaaaatattagaattggcaatgtatttttctatcaacaattgggaaatgcttatacatgtaaatatgaaaatgtttgacattcttatgttaaaaattatttcttgtaacacaaatactttattagaattaaatgcttagtgactta

SEQ ID NO: 26223 - DNA, 4625 bp, Homo sapiens
gagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaatttta

SEQ ID NO: 26224 - DNA, 4128 bp, Homo sapiens
agcctgcggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagccagcagtccaaaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagaga

SEQ ID NO: 26225 - DNA, 3960 bp, Homo sapiens
ggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggttt

SEQ ID NO: 26226 - DNA, 4914 bp, Homo sapiens
agaggccagcctgcggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggtttagagatttttccattggaaatgtgcattttggtttctaatttttttgttttttcatttactggcatactgttatacctcatttttaaaaatcaactgaatccaatatttcctgtggcaaataacactttcctcatttcataccttttctcctctcttccatgccaacatttctccacccacaacgtacactttttatttctccatcaatatttgaaagcgagtgatttgtgaccaggatttttttttcttagggttgcatttataatttacagattgccttccttgggaacaagtatttttttgtatgatctgtctaaaaacctctcacctgaattttgtggtagaaagtctgtatttgttgttgtgagcgtgttaaattgataacaaaccaaactacttgatagctaaagcagattgtttcgggtggggagaaaaagccctaaatcagaatgtttatatttgcctaaagatgtccttaataatacaatatgctttagatcttgcttatttagtgattgtataccaggaaaacaattagactcaaatcagtgatgttcttgttcttggtgttcatgaacatatatcaaagattaaaattgtcctgtgtttcttgtttcaaggtacgtgtgtgtgtgtgtgtgtgtgtgtgtgtgtgtgtgtgaagtcttaaatgttttattagtctacagctaatcagtttattgtaatattgtatgtacagtgagattaatgtcttgcgttttcatcctttgtgaattaaaaattctcacttgttttgtaataacaaagctagtaatattttcctgtcttgacagcttggttttatagtagaaaatatattaaaagctgaaataaattatcagtggaatttta

SEQ ID NO: 26227 - DNA, 4101 bp, Homo sapiens
ggggacgggccggccgcggccgtagccgtgtgaacgctcttcgggctcgcgtcgtcgacccgcagccgcggggcggactaagaagggagccgcctgctgcgaggccgccgggctcccggtttaaatgtgatactggtgtagatctccttgttctaagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgatgaacttagcagcagctccactgaacagataagggcaaccacacctccaaatcaaggaaggccagattctcctgtctatgctaaccttcaagaactgaaaatatcccagtctgctcttcccccacttcctgggagcccggcaattcagattaatggagaatgggaaactcataaagacagctcagggcgttgctattactataacagagggacacaggaaagaacttggaaacctcctcgttggactcgggatgcaagcatcagcaaaggagatttccaaaatccaggggatcaagagcttctttcatcggaagaaaactactacagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaagggggcaacaattgagatggcttcaaaggataaatccagcaaaaagaatgtatttgagctgaaaactcgtcaaggaacagaactgctaattcagtctgacaatgacactgttattaatgattggtttaaagttcttagtagtacaatcaataatcaggcagtagaaactgatgaaggaattgaagaggagataccggattcaccaggaatagaaaagcatgataaagaaaaggaacaaaaggatcccaaaaagcttcgttcctttaaagtatctagcatagattcttcagaacagaaaaaaaccaagaaaaacttaaagaagtttcttacacgacgccccactttgcaagctgttcgtgaaaaaggttatattaaagatcaggtatttggatccaatctcgctaatctgtgtcagagagagaatggcacagtaccaaagtttgtgaagttatgtattgaacatgttgaagaacatggtttggatattgatgggatatacagagtaagtggcaacctcgcagtgatccagaaactaaggtttgcagtcaatcatgatgagaaattggacttgaatgacagtaaatgggaagatattcatgtcattactggagccctcaaaatgttttttcgagaattaccagaacctctttttacatttaatcattttaatgattttgttaatgcaattaagcaagaaccaagacagcgagtcgctgctgttaaggacctaatcagacagttgccaaagccaaaccaagacacaatgcagattcttttccgacatctcagaagagttatagaaaatggagagaaaaatcgaatgacctatcagagtatagcaattgtttttggtcccactctattaaaaccagaaaaagagactggtaatatagcagttcatactgtgtaccagaatcagattgtagaattaattcttctggaactgagttccatcttcggacgttgattcttactgaagacaacctgtggaatagaagctggattccatcagatttcaaatgtttatacacaatgtattttattttttggaccaagcagtgactctttgattttgcactttttttttgagggatcagaagggaaggggagagtcgagatgtgtgttaggccctcatatttgctgctttgttgcaagttgatataactgcgtgtaattatgaattcattttatcctgaatgtttgcatttcatactctgaatttcagtaaaaatcaaaacttaaaattctaaccagtcatatacactggataatttggtaagaaaactgtattttttttccctgaaattggataatgtactttcttctcaagattcatgacttgatagaacaatactttcagttatgttgcaaaggctcttgggcattttaaacaaaatgaagtatatccattttgaaacctgtgtatttctttttcggggtttctgcatgcagtggcagtcttaagtgccaaaattcattataaccccaaaataaccccttgatgaaggcttgctgtcttttactgtgttacacagcatccttactggatatcttagttgcttgtttgggcagcacactaatattacttaaaacactgtgatatactggagttttagttagcggaagtcagttcagggcattttagggctgtcttgctatactgaattgtagctaacaatcctaattatatctagtaccatactgagttattggtatgaccctgtggaaacacacattattttatgtaaatataggctaaagacttaatgtcctttagcttgtgtatataattgtgttgtatagtctcagagtacattctaaccctacatttctaatcattgttattggtaatcttttctgtgaatattaggtttcctccagaaatagtccgttatttgggaaagttaactgtgtgcacttttagatattaactacatttacaggcaaatcactgtaatgagaatggtactggaaaaatactgaatagacttgctaaatggcacatgcactacaagaggaaccttttgggttatttaatatgtacagaaaacattagaaaaaatttattacagaattctaattccagtatgaatagtggaaacccatctgtaaattagatggatgttggatggaaaatgacattgctaaatttgagaatttctttttacctactaatgtagattgctttgtataataaaacacagggtttggaaggttttgttacagggagcatggtctgttgaagatttttaaaatgtatttttctagattaacttctgtacatgaaatgtctaataaaactataagaggttt

SEQ ID NO: 26228 - DNA, 586 bp, Homo sapiens
cagcacttcttacagccagtcagatagtcagtgtggttctcctccaaggggttggtcagaagagttggatgaacgtgggcataccttatataccagtgactatactaatgaaaagtggctcaagcatgttgatgatcaaggtagacaatattactacagtgcagacggatctcggtcagaatgggaattgccaaagtataatgcttcatcccagcagcaaagagaaataattaaaagtaggagcctggacaggcggctgcaagaaccaatagtattaacaaagtggagacatagcaccattgtattggacactaatgataaggaatctccaactgcctcaaaaccctgctttcctgaaaatgagtcttctccctcctcaccaaagcaccaagatacagatcaagagaaatatggattattaaatgtaacaaaaattgctgaaaatgggaaaaaggttcgaaagaactggttgtcttcttgggcggtgttgcagggttcatctttactttttaccaaaactcaaggaagtagcacaagttggtttggcagtaatcagtccaaaccagagttcacagtggacctcaag

SEQ ID NO: 26229 - DNA, 3480 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatgaaaa

SEQ ID NO: 26230 - DNA, 3246 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatgaaaa

SEQ ID NO: 26231 - DNA, 3398 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtttcatgtttaatttgaattaaatatattctgtggtttatatgaaaa

SEQ ID NO: 26232 - DNA, 2613 bp, Homo sapiens
cgccgtttgggccgggaagcgatgtagtagctgccaggctgtcccccgccctgcccggcccgagccccgcgggccgccgccgccaccgccgccatgaagaagcagttcaaccgcatgaagcagctggctaaccagaccgtgggcagagctgagaaaacagaagtccttagtgaagatctattacagattgagagacgcctggacacggtgcggtcaatatgccaccattcccataagcgcttggtggcatgtttccagggccagcatggcaccgatgccgagaggagacacaaaaaactgcctctgacagctcttgctcaaaatatgcaagaagcatcgactcagctggaagactctctcctggggaagatgctggagacgtgtggagatgctgagaatcagctggctctcgagctctcccagcacgaagtctttgttgagaaggagatcgtggaccctctgtacggcatagctgaggtggagattcccaacatccagaagcagaggaagcagcttgcaagattggtgttagactgggattcagtcagagccaggtggaaccaagctcacaaatcctcaggaaccaactttcaggggcttccatcaaaaatagatactctaaaggaagagatggatgaagctggaaataaagtagaacagtgcaaggatcaacttgcagcagacatgtacaactttatggccaaagaaggggagtatggcaaattctttgttacgttattagaagcccaagcagattaccatagaaaagcattagcagtcttagaaaagaccctccccgaaatgcgagcccatcaagataagtgggcggaaaaaccagcctttgggactcccctagaagaacacctgaagaggagcgggcgcgagattgcgctgcccattgaagcctgtgtcatgctgcttctggagacaggcatgaaggaggagggccttttccgaattggggctggggcctccaagttaaagaagctgaaagctgctttggactgttctacttctcacctggatgagttctattcagacccccatgctgtagcaggtgctttaaaatcctatttacgggaattgcctgaacctttgatgacttttaatctgtatgaagaatggacacaagttgcaagtgtgcaggatcaagacaaaaaacttcaagacttgtggagaacatgtcagaagttgccaccacaaaattttgttaactttagatatttgatcaagttccttgcaaagcttgctcagaccagcgatgtgaataaaatgactcccagcaacattgcgattgtgttaggccctaacttgttatgggccagaaatgaaggaacacttgctgaaatggcagcagccacatccgtccatgtggttgcagtgattgaacccatcattcagcatgccgactggttcttccctgaagaggtggaatttaatgtatcagaagcatttgtacctctcaccaccccgagttctaatcactcattccacactggaaacgactctgactcggggaccctggagaggaagcggcctgctagcatggcggtgatggaaggagacttggtgaagaaggaaagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcagtcctcccaaaccgaaggaccctgtatctgcagctgtgccagcaccagggagaaacaacagtcagatagcatctggccaaaatcagccccaggcagctgctggctcccaccagctctccatgggccaacctcacaatgctgcagggcccagcccgcatacactgcgccgagctgttaaaaaacccgctccagcacccccgaaaccgggcaacccacctcctggccaccccgggggccagagttcttcaggaacatctcagcatccacccagtctgtcaccaaagccacccacccgaagcccctctcctcccacccagcacacgggccagcctccaggccagccctccgccccctcccagctctcagcaccccggaggtactccagcagcttgtctccaatccaagctcccaatcacccaccgccgcagccccctacgcaggccacgccactgatgcacaccaaacccaatagccagggccctcccaaccccatggcattgcccagtgagcatggacttgagcagccatctcacacccctccccagactccaacgccccccagtactccgcccctaggaaaacagaaccccagtctgccagctcctcagaccctggcagggggtaaccctgaaactgcacagccacatgctggaaccttaccgagaccgagaccagtaccaaagccaaggaaccggcccagcgtgcccccacccccccaacctcctggtgtccactcagctggggacagcagcctcaccaacacagcaccaacagcttccaagatagtaacaggtgtc

SEQ ID NO: 26233 - DNA, 3498 bp, Homo sapiens
aatgctaatgagcgagttgccaggcgagacaggaacttctttccccttctctgtgtcaggatcgcagaaagtatgtcccttctctcaccatgagctggctctccagttcccagggagtggtactaacagcctaccaccccagcggcaaggaccagaccgtcgggaacagccatgcaaaggcaggggaggaagccacctcgagtcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaatt

SEQ ID NO: 26234 - DNA, 4260 bp, Homo sapiens
tcgcagatatggccagtacactatgaaccaggaaagcaccaccatcaaagttatggagaagcctccatttgatcgatcaatttcccaggattctttggatgaactatctatggaagactattggatagaactagaaaacatcaagaaatctagtgaaaacagccaagaagatcaagaggtggttgttgtcaaagagcctgatgagggagaattggaagaagagtggcttaaagaggccggtttatccaatctcttcggagagtctgctggagatccacaggaaagcattgtgtttttatcaacattgacgcggacccaggcagcagcagttcagaagcgagtagagacggtctcccagaccttgaggaaaaaaaacaaacagtaccagattcctgacgtcagagacatatttgctcaacagagagaatcaaaagaaacagctccaggtggcactgaatcgcagtcacttagaacaaatgaaaacaaataccaaggaagagatgacgaggcatctaaccttgttggtgaagagaagctgatcccacctgaggagacgcctgcccctgaaacagacatcaacctggaggtatcatttgccgagcaagcactcaatcagaaagagagctccaaggagaaaatccagaagagcaaaggcgatgatgccacattacctagtttcagattgccaaaagacaaaacgggtaccacaaggattggtgacctcgcaccccaggacatgaagaaagtttgccatttagccctaattgagctgactgccctctatgatgtattgggtattgagctgaaacaacaaaaagctgtgaaaatcaaaacaaaagattctggtcttttttgcgttccattgacagcgctattagaacaagatcagaggaaagtaccaggaatgcgaatacccttgatctttcaaaaactgatttctcgaattgaagagagaggtttggaaacagaaggcctcttacggatccctggagctgccattagaatcaagaatctttgccaagaactagaagcaaagttttatgaagggacttttaattgggaaagtgtcaaacagcatgatgccgccagcctgctgaagctcttcattcgggagttgccccagccactgctcagtgtggagtatctcaaagcctttcaggctgtccagaatcttccaaccaagaagcagcaactacaggctttgaaccttcttgtcatcctcctacctgatgcaaacagggacacactgaaggcccttcttgaatttctccaaagagtaatagataataaagaaaaaaataaaatgacagtcatgaatgtagcaatggtcatggccccgaatctctttatgtgtcatgcattgggattgaagtccagtgaacagcgagaatttgtaatggcagctgggacagcaaataccatgcacttattgattaagtaccaaaaacttctgtggacaattcccaagtttattgtaaaccaagtgaggaagcaaaacacggaaaatcataaaaaggataaaagagccatgaagaaattgctgaagaaaatggcttatgaccgagaaaaatatgaaaagcaagataagagtacaaatgatgctgacgttcctcagggagtgattcgagtgcaagctccccatctttcgaaagtttccatggcaatacagctaactgaagaactaaaagccagtgatgtacttgccaggtttctcagccaagaaagtggggttgcccagactctcaagaaaggagaagtttttttgtatgaaattggaggaaatattggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattccaccttttcctgctgtatcacaggaagtgatttgcattttttttcagttcatctgacttatgttcacagaaccgtatcagcgaccaagaaaataggactgtcagaagctgccagttattactgaaccattaaatacttatatactaagaataaataaaatatacccatgtgaaataataattggattatggataacaagagagtgaaagccaaagcactttctgtctactgtactcttctaaatggaattttaaaagtcatagctggctttacgtgttgtcattattagcattataaatatgcatgatagtataatccagtaatggttgaagaatgtattttacttaaagagggatttttttttttaagtcctgaataagtctactggaagaattattcttctgggtgaaaaagcttttgtttgtgttcttattttaaataatcggagtcaatttattaaaatgttcttgaaagtactattcccagggattttaatgcacaaaccatattgtgacaagagatgagcctctgtactgtaaataagaaatgaagtagagaaatgttaaatattttatgagtttagaatatagtaaataaaaggtgatgtaaatgaatgctgcacaaacggtgttcatgatacttttagtagtactttaggaaaaactacacattctcagaagctcttgatgtctctaatgaagggggggaatgctgttaatgagaacagtcataaatttttagcatataattacaagaacagcctgtggatatgatcacttaaatgattttgtggtgattcgtgccattgcttttttatttaaaagaaaattttgtaattaaatgcctttttctaaattatcttctcttggaatcattacttttaatcctatgtgtttatgagtatttttgctttttttttattaatattgagaaatggacttttttgttattaaaagtcacctctattttctattttctttgtaatttttaaagtaggaagatgtcagagatgtaaatatgttttcgtctttagtttttttccttttacaaatttttattcttcaggattttcaaaatacagtttagtctgtttctttgacaatatgtattaatttcccaattagcaaaatggtacttattagtgggttgaaaacaattaataatataaaagaaaaattaagtgcttaaaacattttaggagtatacaacttcaaaaaaaaagatagcagtgaggataatgatttaagtaaaaggttgtctgaagcatatgccaactaaatttcgcaacgtttgctacctacctgaaaaggagggtcaggagggagacacaacatatttttgatcatgaaaaagtatcttaattttaaaaaagtgaaaatgccattttattttgaatcccttttagaactcacgacccaagttcatcaatgttgaataatatcacgtttaaataacaaaaaaatatggactttaaaaaatctcaaattttttagagacagggtcttgctctgttttccagattggagtacagcagtgcattcgcggctaactgcagcctcaagcactggggctcaagcaaacctcctgcctcagcctcgtgagtagctaggaccacaggtgcatgccaccatgcctggctctaaagagaaaaaaaacttgataccatagagccttgaatataaatatcctgatgttaacctactgcttttgctgtgattttttttccttagtgagttttaaatctcaggctagatttttatttgtttttctgtgtgtgtatgagacaaaataaaaataaatatatttgccttgagtttaaaa

SEQ ID NO: 26235 - DNA, 1514 bp, Homo sapiens
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaagtattcttataa

SEQ ID NO: 26236 - DNA, 1488 bp, Homo sapiens
aagctttcttcctgtctcttcgatttaccaatgcctcatcagaaactttcagcacttattgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaagtattcttataa

SEQ ID NO: 26237 - DNA, 1427 bp, Homo sapiens
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaagcatttgtttga

SEQ ID NO: 26238 - DNA, 5463 bp, Homo sapiens
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcaacctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggcttttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcatatccaga

SEQ ID NO: 26239 - DNA, 2301 bp, Homo sapiens
aagctttcttcctgtctcttcgatttaccaatgcctcatcagaaactttcagcacttattgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctg

SEQ ID NO: 26240 - DNA, 1901 bp, Homo sapiens
aaaggagagtttctttgtcacaacaaacaaggggaaagctttcttcctgtctcttcgatttaccaatgcctcatcagaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttcc

SEQ ID NO: 26241 - DNA, 8956 bp, Homo sapiens
atggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccatgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaagggaactcaatggcaacaacatcactcggatccataagaatgactttgcggggctcaagcagctgcgggtgctgcagctgatggagaaccagattggagcagtggaacgtggtgcttttgatgacatgaaggagctggagcggctgcgactgaaccgaaaccagctgcacatgttaccggaactgctgttccagaacaaccaggctttgtcaagactggacttgagtgagaacgccatccaggccatccccaggaaagcttttcggggagctacggaccttaaaaatttacagctggacaagaaccagatcagctgcattgaggaaggggccttccgtgctctgcgggggctggaggtgctgaccctgaacaacaacaatatcaccaccatccccgtgtccagcttcaaccatatgcccaagctacggaccttccgcctgcactccaaccacctgttttgcgactgccacctggcctggctctcgcagtggctgaggcagcggccaaccatcgggctcttcacccagtgctcgggcccagccagcctgcgtggcctcaatgtggcagaggtccagaagagtgagttcagctgctcaggccagggagaagcggggcgcgtgcccacctgcaccctgtcctccggctcctgcccggccatgtgcacctgcagcaatggcatcgtggactgtcgtggaaaaggcctcactgccatcccggccaacctgcccgagaccatgacggagatacgcctggagctgaacggcatcaagtccatccctcctggagccttctcaccctacagaaagctacggaggatagacctgagcaacaatcagatcgctgagattgcacccgacgccttccagggcctccgctccctgaactcgctggtcctctatggaaacaagatcacagacctcccccgtggtgtgtttggaggcctatacaccctacagctcctgctcctgaatgccaacaagatcaactgcatccggcccgatgccttccaggacctgcagaacctctcactgctctccctgtatgacaacaagatccagagcctcgccaagggcactttcacctccctgcgggccatccagactctgcacctggcgcagaaccctttcatttgcgactgtaacctcaagtggctggcagacttcctgcgcaccaatcccatcgagacgagtggtgcccgctgtgccagtccccggcgcctcgccaacaagcgcatcgggcagatcaagagcaagaagttccggtgctcagccaaagagcagtacttcattccaggcacggaggattaccagctgaacagcgagtgcaacagcgacgtggtctgtccccacaagtgccgctgtgaggccaacgtggtggagtgctccagcctgaagctcaccaagatccctgagcgcatcccccagtccacggcagaactgcgattgaataacaatgagatttccatcctggaggccactgggatgtttaaaaaacttacacatctgaagaaaatcaatctgagcaacaacaaggtgtcagaaattgaagatggggccttcgagggcgcagcctctgtgagcgagctgcacctaactgccaaccagctggagtccatccggagcggcatgttccggggtctggatggcttgaggaccctaatgctgcggaacaaccgcatcagctgcatccacaacgacagcttcacgggcctgcgcaacgtccggctcctctcgctctacgacaaccagatcaccaccgtatccccaggagccttcgacaccctccagtccctctccacactgaatctcctggccaaccctttcaactgcaactgccagctggcctggctaggaggctggctacggaagcgcaagatcgtgacggggaacccgcgatgccagaaccctgactttttgcggcagattcccctgcaggacgtggccttccctgacttcaggtgtgaggaaggccaggaggaggggggctgcctgccccgcccacagtgcccacaggagtgcgcctgcctggacaccgtggtccgatgcagcaacaagcacctgcgggccctgcccaagggcattcccaagaatgtcacagaactctatttggacgggaaccagttcacgctggttccgggacagctgtctaccttcaagtacctgcagctcgtggacctgagcaacaacaagatcagttccttaagcaattcctccttcaccaacatgagccagctgaccactctgatcctcagctacaatgccctgcagtgcatcccgcctttggccttccagggactccgctccctgcgcctgctgtctctccacggcaatgacatctccaccctccaagagggcatctttgcagacgtgacctccctgtctcacctggccattggtgccaaccccctatactgtgactgccacctccgctggctgtccagctgggtgaagactggctacaaggaaccgggcattgctcgttgtgctgggccccaggacatggagggcaagctgctcctcaccacgcctgccaagaagtttgaatgccaaggtcctccaacgctggctgtccaggccaagtgtgatctctgcttgtccagtccgtgccagaaccagggcacctgccacaacgacccccttgaggtgtacaggtgcgcctgccccagcggctataagggtcgagactgtgaggtgtccctggacagctgttccagtggcccctgtgaaaatgggggcacctgccatgcacaggagggcgaggatgccccgttcacgtgctcctgtcccaccggctttgaaggaccaacctgtggggtgaacacagatgactgtgtggatcatgcctgtgccaatgggggcgtctgtgtggatggtgtgggcaactacacctgccagtgccccctgcagtatgagggaaaggcctgtgagcagctggtggacttgtgctctccggatctgaacccatgtcaacacgaggcccagtgtgtgggcaccccggatgggcccaggtgtgagtgcatgccaggttatgcaggtgacaactgcagtgagaaccaggatgactgcagggaccaccgctgccagaatggggcccagtgtatggatgaagtcaacagctactcctgcctctgtgctgagggctacagtggacagctctgtgagatccctccccatctgcctgcccccaagagcccctgtgaggggactgagtgccagaatggggccaactgtgtggaccagggcaacaggcctgtgtgccagtgcctcccaggcttcggtggccctgagtgtgagaagttgctcagtgtcaactttgtggatcgggacacttacctgcagttcactgacctgcaaaactggccacgggccaacatcacgttgcaggtctccacggcagaggacaatgggatccttctgtacaacggggacaacgaccacattgcagttgagctgtaccagggccatgtgcgtgtcagctacgacccaggcagctaccccagctctgccatctacagtgctgagacgatcaacgatgggcaattccacaccgttgagctggttgcctttgaccagatggtgaatctctccattgatggcgggagccccatgaccatggacaactttggcaaacattacacgctcaacagcgaggcgccactctatgtgggagggatgcccgtggatgtcaactcagctgccttccgcctgtggcagatcctcaacggcaccggcttccacggttgcatccgaaacctgtacatcaacaacgagctgcaggacttcaccaagacgcagatgaagccaggcgtggtgccaggctgcgaaccctgccgcaagctctactgcctgcatggcatctgccagcccaatgccaccccagggcccatgtgccactgcgaggctggctgggtgggcctgcactgtgaccagcccgctgacggcccctgccatggccacaagtgtgtccatgggcaatgcgtgcccctcgacgctctttcctacagctgccagtgccaggatgggtactcgggggcactgtgcaaccaggccggggccctggcagagccctgcagaggcctgcagtgcctgcatggccactgccaggcctcaggcaccaagggggcacactgtgtgtgtgaccccggcttttcgggcgagctgtgtgagcaagagtccgagtgccggggggaccctgtccgggactttcaccaggtccagaggggctatgccatctgccagaccacgcgccccctgtcatgggtggagtgccggggctcgtgcccaggccagggctgctgccagggccttcggctgaagcggaggaagttcacctttgagtgcagcgatgggacctcttttgccgaggaggtggaaaagcccaccaagtgtggctgtgccctctgcgcatagcgctgggcgtggacaggccggtgagggcgggcaaggggccccagccgctgcagcagcggagacagtcgccagcagctgggctggggtgcaggtcatcacaggacggctcctgggcagctgggccctcctgggtggggtggtgccagagcagccttttaaaagcaaattgcgccatagctgggggcagcgggggtgggcgaggcctgagctgcgggctgccctctccggaagtgccttgcacaaataggcgcttaataaatatttgttgagtgaatgtgtgcgtgaggtcaggccaagaagtgcagaacgatgacacccctccttacctgctatctgaatctggagaagaaaaatgacagccttccaaaccaacccttccctttggcctgtggcccaggctggcttggaactgggtctgtggccccagaagcctcttacccctctgcgggcaaccatgaagtactgtcagcctccccgggaagccagcctggttcattctgctgctacagaatctgctggtggtaggccaggctctggagcgggggtgccgcctcctgctggccagggagggtcggacccttgccccctgggctgactggcagctctgcagccacggcttgggaacgaggctgtgggtggaggtggttcttaggaccaggcctctgaatcctaaagttctagcatgactactgtagctgcgagggcttatgtggaggaaacagtcacaggggctgctcagggtggcagaccccactaaagagggcagagggttctttgctctagataaacaaacatcatctgcctccagacactggccacagtaggagtattggtcctgggcttccccagccaccagtcagccacaagctgtcggtgacctattggtagagggactgggtgtgagggtctgggccagggtgcttgacctgggagcagctggttcagagtccttcacaccgcaggccagtagggagcagtggaagggacagtgctccaggcattgggaagtccctgctggctctatcactcggggcaaacttctccccacctgggccttgggttcttcagctataaaatggccagaggtggggggcgggatgactaaaggaacagtgcagactcccccactgtggtcttgggaggccagaggagttagaagacctatctatctatctatctatctacattgatcacatcaaaagtatttatgtgcctaacccggggctggggattgtggacgttctggcctaatggacagatgtgaactcatcccagagcatcgcaggaatgaccaggatgcccgggaagagttgagctgagtgggggctccagccacagacagcggcccaggccagggagttgctggcaacgaaggagccagtggtggaagaagaagaggccctgaatatacgattgcctgcccacgttgtcttctcttccatacacagtgaaaatgtagaaagatggtttgtgaggccaaactgtgaatgggctaaagggaggcaaagttgcactctccttccccagagggctcaccaagagggcacacccccgggggttctggtgggcaacgggggtgagcatgtccctgccctggctccctccatctgtgaccaggaggcatggctgggtgtatgttcaggtgaggctcagagtggcattgtgtccctgtcccctgcccagggcagtgaggggagcccttgatgctgattagaaggctagaactggggtagaggtgcctggcatgtctcatgccatggggactcaatctagcaactgtgagtcctggggtccctgtgatgggaagagggcagtgccctgcccaatgtggcaggtgtcctcatggcaggatctgcccctcaccagggggctgggatctacttgcttggagctctgagcaaggccacaatgcccgcccccacccccaagtagactgcagcctgggcctcatggggcttctcccaggcccacatggcatccctctctgagtttccaggccaccgtgggaccctgcagagcatctgcaccgggctggatagggcagaaaagctcaagggcagctagcttgcctcttccctggaagaaaggtgctctgggactcaccaaccctgagaaagatagctttcctggccaccaccattccccaccaccctggagaagccaattcccaggcttgaagggcactggctggcaggaggcctcttcattctgcaggaggtggaaaggacacctgtagacaggtgatgctcacccctcacctggcgccatggggctgggaggtgagcggctggcatgtttgttcctagggagcaccatgtgagcttaaggctcccctgaccggccccaccacatggcccagcctcctagcacagcagcgctgacctcagtgcagtctgaggattggaatccaccatgagatgatgtgagagctgtgtgccccaggatcaactttttctccaacttggccatcagccagcgagttgctaaggacctgagtcagcactcacgttgcctattcacactccgcttgaaagtccggaaggtggctactgcaaaatcacccctctgagaagtcctctctccacatcttgtccccctttgtgaagacccctagttcgctctgcattttaggcatgaagagatacagcagggtgcgtccggagggagctgtggccttgcaacaccactggcaacagggccggggctcccggtgaaggtgtcaggaagtggaaaaggctggactttgtctcctctttgcctgctggtagcctaaccgcaaaagtatctctttatacagaatacttacagattctaatatatatttgtatttcattttgttacagtatttttatatgttaaagtcaacatccagcgtcttgttttgcctttcagatgctatgtggtcgtggcacgttttgttgggggtttctgtagtcgtcttgtttggatcaactcctagaggctggtttagaacaggcccatgagggagctgcacctgccctggaagtattgttttagactatgtcgatattgtctgttgtcttccatgtgaacatgacattgagtcactctgc

SEQ ID NO: 26242 - DNA, 4210 bp, Homo sapiens
atcaatatgacaacatgattttgtctttatatcagtaagcagcttctactatgttttcctattttctgctagctacagtttacaaaggatgtcacagcactggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcaggcgaagtgggaggagtctatcacacggtaatgtcactagtggattctgtgatgtccctgatggacagctggaactgtaggaagaaggaggactgttgtccacactgtagctgccttgtctgcagaaatccccgattcttgtaaatgcaaacatagttgatctgtggtgtaaagtttctcataagattattgtaaacagatcaatactactttcttaaaagtttttctgctgtttcttgttatttctgaagcagaccctgaggagaaatagcatgattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgat

SEQ ID NO: 26243 - DNA, 3526 bp, Homo sapiens
ttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcgggtaggagacaccagcccaccggatttcctcaagtcattaattcagttttga

SEQ ID NO: 26244 - DNA, 7167 bp, Homo sapiens
gcgggatcgtccggctgcggggtccggctcacgccgggcgggcgggcggggcgcgctgtcccggagccggccagccccgtgcggatccactcgtcccgcttcctctggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgctacagtttacaaaggatgtcacagcactggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtgaattttg

SEQ ID NO: 26245 - DNA, 590 bp, Homo sapiens
aaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttattcagctactagtgactcaacaaaatctaagggttcttggggatctggaaaggatcagtatagcagggaactgcttgtgtcctccatctttgcagctgctagtcg

SEQ ID NO: 26246 - DNA, 340 bp, Homo sapiens
tatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactattcctttcagctcatctgaagacagtggcag

SEQ ID NO: 26247 - DNA, 3829 bp, Homo sapiens
cccggccgggcccggcgcccggccagcgtctccgcttcagctcgccgccgcgcttcggccgccgggcccgagcgggcgggaagggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgag

SEQ ID NO: 26248 - DNA, 3859 bp, Homo sapiens
cccggccgggcccggcgcccggccagcgtctccgcttcagctcgccgccgcgcttcggccgccgggcccgagcgggcgggaagggatctctctaggagctgacactcgaaccttcacgacccattcggatttttccaggactcaggagtggcactgggaagaaggggaccgctttctgcaattggcctcgacactggctgccaagaagacctgtcgcctttgtttttaagtctccagaaatggaagaagaaggcgaagtcagttgaagtcacgagaaatcagcgaggcatttgaaggcgcttcctgaaaacctttattccctggcacgttgtctgtttcaacagccctgcccctcctcggagcctgcttgtggaattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgctacagtttacaaaggatgtcacagcactggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcagtttaaaaaaattccaccagatctaaaaacattgcagtcaaacagaaattttcagactacttgtggaatgtcactgcctcggggtatttcacaagacaggtcacctcttgtgaaagtccgaagtaattctctgaaagctccttccacgcatgtcacaaaaccatcatttagccagaaatcatttgtttctatcaaagaccaaagaccagtaaatcacttgcatcagaacagtctgttgaatcagcagacatgggtaaggactgacagtgcccccgatcagcaagtggagactgggaaatccccctctttatctggagcctctgccaagcctgcccctcagtcgagtgaaaacgctggtacttcagatttagaactacctgtcagtcaaaggaatcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgag

SEQ ID NO: 26249 - DNA, 4343 bp, Homo sapiens
aattcttccccttcgggtgtgtggtggcattccccgccacgtccaatgtggactccaaaggatttgtcccttctttgtcatttgaaatgaaatgatggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtggcatattctcaagatgcctacctgaaaggcaacgaagcttatagcggcaatgcccgcaatatacctgaacctccaccaatctgctatccctggctgccatctgccccatcagccatggcacagccagttgaaatatctcctcctgactcatcattgagcaaacagcaaaccagtacaccagtactgacacaacctggtagggcctatagaatggaaatacaagtgcctccatcaccaacagatgttgcaaaatcaaacacagcagtgtgtgtttgcaatgaaagtgtaaggactgtcattgtgccttctgagaaggttgtagatttgttatccaatagaaacaaccatacaggtccttcacatagaactgaagaagtgaggtatggcgtgagtgagcagacctctttaaaaacagtgtcaagaaccacatcaccaccattatcaattcccaccactcatctaattcatcagcctgcaggctccagatcactggaaccttctggaattttacttaagtctggaaattacagtggacattctgatggaatctcaagcagcagatctcaagctgtggaggctccctctgtatctgttaatcactattcgccaaattcccatcagcacatagactggaaaaactataaaacttacaaagagtatattgataacagacgattgcacataggttgtcggacaatacaagaaagattagatagtttaagagcagcatctcaaagcacgacagattataaccaggtcgtccccaaccgcactactttgcagggacgacgtcgaagcacctctcatgatcgagtgccccagtctgtccagatacggcaacgcagtgtgtcccaagaaagactggaagattctgtgctaatgaagtattgtccaagaagtgcatctcaaggagcactgacgtctccatctgttagttttagtaatcatagaactcgttcatgggattatattgagggacaggatgaaaccttagaaaatgtcaattctggaactccaatacctgattccaatggagagaaaaaacagacttacaagtggagtgggtttactgaacaggatgatagacgaggtatttgtgaaagacctaggcagcaagaaattcataaatcttttcgaggttccaattttactgtggctccaagcgttgttaattctgataacaggcgaatgagtggtagaggagtgggatctgtgtcgcactggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcagtaaagcagagtttcatccctgtctttaaactgggggtatgtccactctagcaa

SEQ ID NO: 26250 - DNA, 568 bp, Homo sapiens
ggccacgcgtcggactggtctgtctgagggagatggtgacaagctcaaggcctgcgaggtctcaaaaaataaagatggaaaagaacaaagtgaaactgtatcactgtctgaagatgaaacattctcctggccaggtcccaaaacagttacgttgaaaagaacatctcaaggctttggttttacattaagacattttattgtttatcccccagagtctgcaattcaattttcatataaggatgaagaaaatggaaacagaggaggaaaacaaagaaaccgcttggaaccaatggataccatatttgttaagcaagttaaagaaggaggacctgcttttgaagctggattatgtacaggtgaccgaattataaaagtcaatggagaaagtgttattggcaaaacctattcccaagtaattgctttaattcaaaacagtgatacaacattggaacttagtgttatgccaaaagatgaagacattctccaagtgaatctggaattctctacattttacaaaaataccattgccaagtttttgcaattaagtgacatggaaatgttatgttga

SEQ ID NO: 26251 - DNA, 5896 bp, Homo sapiens
atgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 26252 - DNA, 5929 bp, Homo sapiens
ctgccacccgatgaatggagtcgccttctgcctggtcgggatcccgccccgcccggagccccggcccccacagctgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagcggacctgttggagatttaaaggattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 26253 - DNA, 6276 bp, Homo sapiens
gaaggatgcgtgtgtgccggtctgctgtgcatgtgtgtatctgcatgtctgtgatgcatgcgcatgcgtctgtatgtgcattgtgtgtgcaggactttgattctgtgcaactctgtgcatatctatgtgtctacaaaagtgtgcacatgtgtactcatttgtgtgtgtgtatctgtgtgtctgcatatttgcacatgcttgtctgtatgtttgtggtatgttccgtctacatgagtgtatgtggctggggctgtgtctgcataagtatgtgtctatctgggagtgcatatatgtgtgcatgtgtgtgtgtgagattgtgcatgagctaagacaacgacaggcacttcctgggcaggaaggctgtatccagggtcctgcacatagtaggtgctcagtgaacatttgctgaactcagctgaactgaactgaatgaacttgcttcactgccactgggcccaagagatgggtgctctcctaggcgccccttcccctggcaggggccgaggacgctgctgctgtacaaaagtccccaggacggctttggcttcactctgcgccacttcatcgtgtacccacccgagtcggccgtgcactgcagcctgaaggaggaagagaatggaggccgtggaggaggaccctccccccggtaccgcctggagcccatggacaccatctttgtcaagaatgtgaaggaagacggccctgcccatagggcggggcttcgcacaggagaccggctggtaaaggtgaatggggaaagcgtcattgggaagacctactctcaggtcatagctctgatccagaatagtgatgacactctggagctgtctatcatgcccaaggacgaggacatcctccagctggcctactcccaggatgcctacctgaaagggaacgagccgtattctggagaggcccgcagcatcccagagccaccgccgatctgctacccccgcaagacctacgcccctcctgcccgggcctccaccagggccactatggtgcctgagcccacctcagcactgcccagtgacccccggagtcctgctgcctggagtgacccggggctccgtgtgccacctgctgcccgtgcccacctggacaactcttccttggggatgagccagccccgccccagccctggtgccttcccccacctctcctcggagccccggacgccccgtgccttcccagagcctggcagccgggtgccccccagcagactggagtgccagcaggccttgtcacactggctgtcaaaccaggtaccccgccgggcgggggagagacggtgcccagccatggccccccgggcccgcagcgcctcccaggaccggttggaggaggtggctgccccccgcccgtggccctgctccacctcccaggatgctttgagccagctgggccaggagggctggcaccgagctcgctcagatgactacttgagccgggccacccgttctgccgaggcactggggccaggggcactggtgtcaccccgctttgagcggtgtggctgggcttcccagcgttcgtctgcccgcacccccgcctgcccaactcgggacctgccagggccccaggccccacccccgtctggcctgcagggcctggatgacctcgggtacatcggctaccggagctacagcccatcattccagcgccggaccggcctcctccatgcgctctccttccgggactcaccctttggggggctgcctaccttcaacctggcccagtcccctgcgtcattcccaccagaggcctccgagccacccagggttgtacggccggaacccagcacccgggccctggagcctcctgcggaggatcgcggcgatgaggtggtcctgaggcagaagcccccgacgggccgcaaggttcagctgacccccgcaagacagatgaaccttggatttggtgacgagtccccagagccagaggccagtgggcgaggggaacgcctgggcaggaaggtggcccctttggccaccaccgaagactctctggcttccatcccctttattgatgagcccaccagccccagcattgacctccaagccaagcacgtccctgcctctgctgtggtctccagtgccatgaactcagcccctgtcctgggcaccagcccatcttccccgaccttcactttcaccctcggacgccattactcgcaggactgcagcagcatcaaggctggccgccgctcctcctacctgctggccatcaccacggagcgctccaagtcctgcgatgatggactcaacaccttccgcgacgagggccgggttctgcggcgcctgccaaaccgcatacccagcctgcggatgctccggagcttcttcaccgacgggtccttggatagctggggcacctctgaagatgctgacgctccttctaagcgacactcaacctctgacctctcagatgcgaccttcagcgatatcaggagagaaggctggttgtattataagcagattctcaccaagaaggggaagaaagcgggcagcggcctgcgccagtggaagcgggtgtacgccgcgctgcgggcgcgctcgctctcgctgagcaaggagcggcgggagcccgggccggcggcggcgggggctgcggcggccggcgcaggtgaggacgaggcggcgcccgtctgcatcggctcctgcctcgtggacatctcctacagcgagaccaagaggaggcacgtgttccggctgaccaccgctgacttctgtgaatatctctttcaggctgaggaccgggatgacatgctgggctggatcagagcgatccgggagaacagcagggccgagggcgaggaccccggctgtgccaaccaagctctgatcagcaagaagcttaacgattatcgcaaagtgagccatagctctgggcccaaagctgattcctcccccaaaggctctcgcggcctggggggcctcaagtctgagttcctcaagcagagtgcggcacgtggcctcaggactcaggacctgcccgcagggagcaaggatgacagtgctgcagcccccaaaaccccctggggcatcaacatcatcaagaaaaataagaaggccgctccgagggcgtttggggtcaggctggaggagtgccagccagccacggagaaccagcgcgtccccttaatcgtggctgcatgctgtcgcattgtggaggcacgagggctggagtccacaggcatttaccgagtgcccggcaacaatgcagtggtgtccagcctacaggagcagctcaaccgcgggcctggtgacatcaacctgcaggatgagcgctggcaagacctcaatgtgatcagcagcctgctcaagtccttcttccgaaagctgcccgagcctcttttcactgatgacaaatacaacgacttcatcgaggccaaccgcattgaggacgcacgggagcgaatgaggacgctgcggaagctgatccgggatctcccaggacactactatgaaacgctcaaattccttgtgggccatctcaagaccatcgctgaccactctgagaaaaacaagatggaaccccggaacctggccctggtctttgggccgacactggtgaggacgtctgaggacaacatgacagacatggtgacccacatgcctgaccgctacaagatcgtggagacactgatccagcactcagactggttcttcagtgacgaagaggacaagggagagagaacccctgtgggcgacaaggagcctcaggcagtgcccaacattgagtacctcctgcccaacattggcaggacagtgccccctggcgacccggggtcagattctaccacctgtagttcagccaagtccaagggttcgtgggcccccaagaaggagccgtacgcccgggagatgctggcgatctccttcatctcggccgtcaaccgcaagcgcaagaagcggcgggaggcgcgggggctgggcagcagcaccgacgacgactcggagcaggaggcgcacaagcctggggcgggggccacagcgccggggactcaggagcggccgcaggggccgctgcctggcgccgtcgcccccgaggcccccggacgcctcagtcccccggcggcgccggaggagcggccggccgcggacacgcgctccattgtgtcgggctactccaccctgtccaccatggaccgcagcgtgtgctcgggcgctagcggtcggcgggcaggggcgggggatgaggcggacgacgagcgtagcgagctgagccacgtggagacggacactgagggcgcggcgggcgcggggcctggggggcgcctgacacgccggccgtccttcagctcgcaccacctcatgccctgcgacactctggcgcgccgccgcctggcccggggccgcccagacggcgagggcgcgggccggggcggtccccgcgccccggagccgcccggctcggcgtcgtccagcagccaggagtcgctgcggcccccggcggcggcgctggcctcccggccctcgcgcatggaggcgctgcgtctaaggctccgcggcacggcggacgacatgctcgccgtgcgcctgcggcggccgctgtcgcccgagacccggcggcgccggagcagctggcgccgccacaccgtggtggtgcagagcccgctgactgacctcaacttcaacgagtggaaggagctgggcggagggggccccccggagcctgcgggcgcgcgggcgcacagtgacaacaaggactccggactcagcagcctggagtccaccaaggcgcgggccccgtcgtccgctgcctcgcagccgcccgcgcccggggacacggggtccctgcagagccagcccccgcgccgctcggccgcctcccgcctgcatcagtgtctgtgatccccacctcccgcgccgctcgggcgccacccctccctagagcccctttggaaccaggaggcttcaccagcctgcacctcctcttctgtggcccctgggtgcatggtgtgggtggagggcgcagcaggcagtgtctctagttggtgtgctggaactggcagggcagaggagaaggctggggccggactaattgaatggaagggggttccagaggtgatgagcagaagaggagggggcgtgggctgctggggtctgtgtccctgcacacatgcgcccgataggtccttctgagcctttctgtggctgcacttggggacccttgtggaccatggggtgtggctagggaacccctaagtttcagactaaaggaaagatcctgggtgatgctggctttttgcttctttcttctgccctcccacctcagcttgtaagcggggatgtgtgtatgtctggggagaggaggtgtagggtgcgtatgtccatggggggaggggcttgtgtgtgcagtcattgtcccaaggtgtttccagtagcgacttctgtccccctatccccaccctggtccccactttgcgcccccgggctccctgcctttggtgcacacaggatcctgcccgccccccttgccagagccagagaagggggttggggccattccaaggaggcaggactgaaaccctcaccagggttactccccaacatccttttgcctgagtcaccctctaagcgctttaaccacgggcagctgcctgttccccagacagtttttggtggggggggtccagggtcccccttgctggtacctccctcacccctctttttgtttttccatctgtgcctgttccttccacagcccaggcacacagaagcccaccttcttccccttaggaggagggatagtcaacacccctgctgtctctctgtcactcacacactgatttatggggtctgagctgggctgttcctgcaggatggacaggacccagcgccctcttctccccacaggctgtaaatagacttccaatcaccaggccagcccccacacaccctcactcattccagggaagcccaggtaggtggtgaacccgctgccacgtctatcagtcctcttgttttatgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttcctcaaggcatga

SEQ ID NO: 26254 - DNA, 4572 bp, Homo sapiens
gggagtttgaagacagaaaggaaaggggagaaacctgcagagagcatcaaaggatggggggtgctataaaagaagcaggggggtcctttgaaagaaatctatcatgcactgaaatgctttctggagaaggtgccattattttcctcccctcttgctcagatgaaaggagccagcaaggacagtcctgaaatattcctcaggggactttttgtcattgttcctctttcctcttgcacagagctatttgctgacctttccagaggaatctcagtccagctgagaagacagttcttaataaaaacaaaaaaatgcaaaaaccaattcctgctgtttgaatgggaatggtagcttgcttgctgcagttcttttcctgtgacattttggaatgtctgcagaaacttaaaaaaaagaaaaaaaaaaccttaaaaactccctggattaggcaagagaaaaggaagtttttttttgctaaacaggagtaaatgagaggtggtaacttatccctaagccaggacctggatgatcaaaaccttcaaattctagggatcagcacttcaaaaataacaagtaaacaagcatgaggagtggctgttgggtttcgctcagaggcaggttttaaaggaagccaaaaccgggttcagaacttcaggcctgtacgatgcctgaagaccggaattctggggggtgcccggctggtgccttagcctcaactcctttcatccctaaaactacatacagaagaatcaaacggtgttttagttttcggaaaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccata

SEQ ID NO: 26255 - DNA, 2740 bp, Homo sapiens
ggatgggaggatactgactaagtctgagaaggaggagaaagaaaattagctacaggaagagtttatatccccttctacaagaaaacttaaatatagctaccaccgctttgaaaggaatggtttgtgtccaaacagcattttccagacaagctctgtacttttttgccaaaagaattaactttaaactgaaggcagtggacagttaaacaagagtcggcactgggaacagctgtgcgtagaccagaccagtgacttataaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaata

SEQ ID NO: 26256 - DNA, 4661 bp, Homo sapiens
ttgtactgtatatttacacattcacacacaatcaccctttctaacttctgggactctttgcgcaactgctaggatttctcaagtgcatgtggcaacacagcccagctccgggtggaaaccagcagggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcaggtgttaaggaattagcaaagcaggtgaagagtttgccagtggtaaattacaacctcctcaagtatatttgcagattcttggatgaagtacagtcctactcgggagttaacaaaatgagtgtgcagaacttggcaacggtctttggtcctaatatcctgcgccccaaagtggaagatcctttgactatcatggagggcactgtggtggtccagcagttgatgtcagtgatgattagcaaacatgattgcctctttcccaaagatgcagaactacaaagcaagccccaagatggagtgagcaacaacaatgaaattcagaagaaagccaccatggggcagttacagaacaaggagaacaataacaccaaggacagccctagtaggcagtgctcctgggacaagtctgagtcaccccagagaagcagcatgaacaatggatcccccacagctctatcaggcagcaaaaccaacagcccaaagaacagtgttcacaagctagatgtgtctagaagcccccctctcatggtcaaaaagaacccagcctttaataagggtagtgggatagttaccaatgggtccttcagcagcagtaatgcagaaggtcttgagaaaacccaaaccacccccaatgggagcctacaggccagaaggagctcttcactgaaggtatctggtaccaaaatgggcacgcacagtgtacagaatggaacggtgcgcatgggcattttgaacagcgacacactcgggaaccccacaaatgttcgaaacatgagctggctgccaaatggctatgtgaccctgagggataacaagcagaaagaacaagctggagagttaggccagcacaacagactgtccacctatgataatgtccatcaacagttctccatgatgaaccttgatgacaagcagagcattgacagtgctacctggtccacttcctcctgtgaaatctccctccctgagaactccaactcctgtcgctcttctaccaccacctgcccagagcaagacttttttggggggaactttgaggaccctgttttggatgggcccccgcaggacgacctttcccaccccagggactatgaaagcaaaagtgaccacaggagtgtgggaggtcgaagtagtcgtgccaccagtagcagtgacaacagtgagacatttgtgggcaacagcagcagcaaccacagtgcactgcacagtttagtttccagcctgaaacaggaaatgaccaaacagaagatagagtatgagtccaggataaagagcttagaacagcgaaacttgactttggaaacagaaatgatgagcctccatgatgaactggatcaggagaggaaaaagttcacaatgatagaaataaaaatgcgaaatgccgagcgagcaaaagaagatgccgagaaaagaaatgacatgctacagaaagaaatggagcagtttttttccacgtttggagaactgacagtggaacccaggagaaccgagagaggaaacacaatatggattcagtgagcctgctttcgcctgctgtctctgatggctctggcaaggactccagggattctggtgggatatgacttagaaccaggtggctggtcacctggatgtacagaagtctaactggtgaaggaatatcatttacagacattaaacatccatatctgcaatgtgtaccaaagttatatcatgccccataatgctactgtcaagtgttacaactggatatgtgtatatagagtagtttttcaaaagtaaactaaaaatgagaagcatatttcaagaattattttattgcaagtcttgtatttaaatgttaaatcaatatgttgttgcaatttagcttgctttcaagcttcaccccttgcacttaacataagctatttttggcattgtgttatcatcggcttattttatagatcaatatttttatttcccttttttgctgaggaaatgaagataagcaaaaatataaatatatatataaatatatgagttattaaaatcagaagaatactttgtggctgtgctgtttgtgccaatagactttgtcatgaccaaaaagagaaatgtaaatagttttataaaatacagtcgaatcaccaggaacctttgagctgcttttaaaattcttcccctggcaccactcagttttgcttttgcgaggcgatttgacataggaactttgagactccatgagaaagtccctttctgaggcccactgtctaccttgccagatcctcagtgcgtatcgccaatgcaggatgctccttagaaaagaaaaaatggtaaagaatggcatttaacgattcaggctttgaattactctgtccctctggaccgaatctctttaactgctggatagttttagaggaattctcctgctacttaggtactgggaaacaatgcttgctaaaccatgcccacgtgagcacctgtctcccactcaaacctctcccatctcccaacaactgcactttagaataccagcagtgaaatggtattactgtttccctctgagtgaaactgctagagtatatgtcacgtagtgacatttttttctcactcaggctattgccatctgggattctctccctactacagctggcaaagttggtttgcagcaagaagatagtgggagggggccaggctgcaggagaaggagaaaagtttagaagaaacaaaccattttgcttctaattttgacagtatcactttcctgttaaaacatacaataattttaaaaggtgaatgcctaaagttccaattttagcaaatatgggaacctcagcaatgctaattttctagaaaaacccagggctctttggagctagagttttgggagaacagttcttcacaataaggcaatggttttgagaggccaggcaaataatctttctcaccgtagaacaaaaagttacaaaaggcataatcggaaatagagactacatacttgagtttatggggtttgtgttgtttgaaggttcaatgcttgcatgtgtttatttattttcaagagggaaagtggtctgtactgctttcatccttgccactgtcttgcttttattttttactctcccactgagcaagcgtctgtggtcctatggtatcaaccagtatctttatagcaataatttctttaattcccttttctctctctttccaattatttaaccagttacttccacctggacatacgataggaaattcaaactcaaaatatgaaaattgatcttaataactctcccttcatatcttttcacctatttccagtccttatcatagttgataaaaacctcagactcatccagaaagctatatgatgcactagtaaaaaaaacaaagatattcaaactgcttgggttcaaatggtatacaatttgccagctgttactgaaccttctatgcataactttttttttcctctgtgcaattggaataataaaaatactactcccataga

SEQ ID NO: 26257 - DNA, 1273 bp, Homo sapiens
gggctctggaggggctcggagaccaggggagctgtcaaggctgcggcggggaccagagaggagcctggcgggggtggctgggtggctgggggaatccccccaacttcccatcgcaggcgcagctctctcggccgcctatttcctccgaaacccgcgctgcggagcagcccagtgcatagagttcaacacttccccttgttgtggaaagtaaaggagcctcactaccacctttttttctttgcgttttcttactgctggtcctgggagccttttccttcggagcagcagccctgtccggcatctgtcttgagctcccagcaaggaaagtccatcagcttgataatggaggagaacaatgactccacggagaacccccaacaaggccaagggcggcagaatgccatcaagtgtgggtggctgaggaagcaaggaggctttgtcaagacttggcatactcgctggtttgtgctcaagggggatcagctctattatttcaaagatgaagatgaaaccaagcccttgggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgccaggccaggctaatcttgttaaggagctccaagatgcctttgactgtggggagaagccatcatttgacagcaacacagatgtacacacggtggcatcacttcttaagctgtacctccgagaacttccagaaccagttattccttatgcgaagtatgaagattttttgtcatgtgccaaactgctcagcaaggaagaggaagcagtaagttgatgcatttatttccaaataagcttttgtttggaatttttttctgtgttcttagtcttaaatctgtaaatttccattgccctatcccggtgttactctccactatcctttgaattgacctcacacacactgagactttccgtatacagctcaagcaccatttccgatcccctctctgatcaaaaaaaaagaa

SEQ ID NO: 26258 - DNA, 567 bp, Homo sapiens
ataactcattaggcttgaatgagatgctttgaactgtggtgactacagtaatgttcccctctgcatgttgaagtgacaagtgcctccttggcctattgctgatcctgcctgctgtagaaatctccagctgtccaatatttggaagaaaactggctgtgcgtgtagtagagatgctctctctttgtgaagaaggccctgcatacattaaacaagtccggtactatttttctgcctggaaataaagtttctgagcatccctgcaatgaagagaacccagggaagttcctttttgaagtagttccaggaggcgatcgagatcggatgacagcaaatcatgaaagctacctcctcatggcaagcacccagaatgatatggaagactgggtgaagtcaatccgccgagtcatatggggacctttcggaggaggcatttttggacagaaactggaggatactgttcgttatgagaagagatatgggaaccgtctggctccgatgttggtggagcagtgcgtggactttatccgacaaagggggctgaaagaagagggtctctttcgactgcca

SEQ ID NO: 26259 - DNA, 2979 bp, Homo sapiens
acacacacacacacaaaaccaagaggcagcagttgtttatcacgacctcaactcagtaaggcctgagattctttcgaaaaggagctttgcttcccatgacgcagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagc

SEQ ID NO: 26260 - DNA, 2936 bp, Homo sapiens
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 26261 - DNA, 2945 bp, Homo sapiens
agtaaggcctgagattctttcgaaaaggagctttgcttcccatgacgcagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 26262 - DNA, 2939 bp, Homo sapiens
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaattaaaaaaaaaa

SEQ ID NO: 26263 - DNA, 1227 bp, Homo sapiens
gtttacctaagctagcctgggcaatggcgggcgcccctcccccagcttctctgcggccttgcagtttgatctcagactgctgtgctagcaatcagcgagactccgcgggcgtaggaccctccgagccagagtctcctgcaatgattcagacttggctttactggcttcttccatagataagcaccagcctaggagctctcaaagttgttccagctaaaggacacactcagcttttggtctacagtgacttccagcctaagtggctctggacactgctggaaccccccgctccatctccctccataaatatgtctctgcagcagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaagaactacaggaacaggaatgactgccaaagtgttgtttctgcacagatacaccaattctgtcccagggtctccttgctggcacatgggcaggctcatttactggtaaatgatttacttgtgtaaatctcttcccaggctcagcaggagttgatgaagca

SEQ ID NO: 26264 - DNA, 2156 bp, Homo sapiens
ccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggccctttctcagtgctatctga

SEQ ID NO: 26265 - DNA, 1843 bp, Homo sapiens
gaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttgaggggggtgagtgacaagtgtgccaatcacccagtgactgagcaatgaggtcctcactgaagcccactctgaaagagagactcaaatacagtccagagaagttcagtgggaaaaatgtatacaacattgtaaatgttttggtcagaattgttgaaaattctgggtgaacgtccagagaaaactggtttcctgctaacccatgaaacgtgattcctttctcagagta

SEQ ID NO: 26266 - DNA, 2515 bp, Homo sapiens
atgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagagctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagc

SEQ ID NO: 26267 - DNA, 1101 bp, Homo sapiens
cagagtctcctgcaatgattcagacttggctttactggcttcttccatagataagcaccagcctaggagctctcaaagttgttccagctaaaggacacactcagcttttggtctacagtgacttccagcctaagtggctctggacactgctggaaccccccgctccatctccctccataaatatgtctctgcagcagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagcctcatgggaccagaatcgcatgggacaggactcctatgtcctcatggccagctctcaggcggagatggaggagtgggttaaattcctcaggagagttgctggcacaccctgtggagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaagaactacaggaacaggaatgactgccaaagtgttgtttctgcacagatacaccaattctgtcccagggtctccttgctggcacatgggcaggctcatttactggtaaatgatttacttgtgtaaatctcttcccaggctcagcaggagttgatgaagca

SEQ ID NO: 26268 - DNA, 2247 bp, Homo sapiens
cagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccagggctgcatgtatctaccaggatgtacaatcaaggagatcgccacaaacccagaagaagctgggaagtttgtctttgaaatcattccagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacagagacacagatgtgcacactgtggcttccctgttaaagctctacctccgagacctcccagagcccgtggttccctggagccagtacgaagggttcctgctctgtgggcagctcacgaatgcggatgaggcaaaggctcagcaggagttgatgaagcagctctccatccttcctcgtgacaactatagtctcctgagctacatctgcaggttcctacatgaaatacagctgaactgtgctgttaacaagatgagtgtggacaacctggctactgtgattggtgtgaatctcatcaggtcgaaggtcgaagaccctgccgtgatcatgagagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatgacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaaccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaagga

SEQ ID NO: 26269 - DNA, 6862 bp, Homo sapiens
ggcggggcggccgaggctgctgtgagagggcgctcgaggctgccgagagctagctagcgaaggaggcggggaggcggcgtctgcactcgctcgcccgctcgctcgcttcccggcgccgctgcgggtccgcgctgcgtttcctgctcgcgatccgctccgttgcccgcgcccggaacagcagcacctcggccgggtccgagctcggttcgggagtcttgcgcgccggcggacaccgcgcgcggagtgagccagcgccacacctgtggagccggcggccgtcgggggagccggccggggtcccgccgcgtgagtgctctgggcggcgggcggcccgggccccggcggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaagg

SEQ ID NO: 26270 - DNA, 9200 bp, Homo sapiens
gagagggcgctcgaggctgccgagagctagctagcgaaggaggcggggaggcggcgtctgcactcgctcgcccgctcgctcgcttcccggcgccgctgcgggtccgcgctgcgtttcctgctcgcgatccgctccgttgcccgcgcccggaacagcagcacctcggccgggtccgagctcggttcgggagtcttgcgcgccggcggacaccgcgcgcggagtgagccagcgccacacctgtggagccggcggccgtcgggggagccggccggggtcccgccgcgtgagtgctctgggcggcgggcggcccgggccccggcggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccacactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcttctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtacttattaaatggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggtatttt

SEQ ID NO: 26271 - DNA, 1632 bp, Homo sapiens
accccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaa

SEQ ID NO: 26272 - DNA, 2976 bp, Homo sapiens
attttgtgatgagacctttatagtttggcaggctcttggcaggatgaagatgaagctgttttctctccatctggccaggtctacaactcgaacaaagacagccagagtgaagggagtaagtacgatgcttgggtaaccttctacagccagggttgggagtaggctttgagaagttgctactccaggtgtgaaccaccaggcggtgctgtgggcgtgttgggttggctccagttcccgagtgcagtgggacatgcctccaccccaactttccgccagtgactccagagggacgctgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatact

SEQ ID NO: 26273 - DNA, 2870 bp, Homo sapiens
ctgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttg

SEQ ID NO: 26274 - DNA, 1376 bp, Homo sapiens
ggaagttctgcccggcgctctccgccggtgcctccctggttatattgttgaacaggaaacccggcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactg

SEQ ID NO: 26275 - DNA, 3628 bp, Homo sapiens
acatgagcaggcagccccgactggaaggagcccggggccctcattccttctcctccactgggaactgagtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacaccatcccattttacagacaaggacgctgaggcctgcagcagcagtgtgacttgctcaaggtccagtgagtgacctcattccccagaaaaggctcctcccacaccagagtacagcctgggtagggggaaaatcagttctttcagctaccacccatccaacctttgggcctatgtgaaaagaaaggaactaagctgggtgtgttctgtctggacctggggaggcccctgaaggcaaagagggaaactgtcccagctgttctgtcctaggggagggggacatagccctagcaggagctcccagcccctcttggcactctgacacacaagtacacccatctggggcccgctttgccacgaagagctgggcaggcctgcagggtgtggggaaggaggacacaacctcaagaaaggaagcgtgaaccccagggaacagcgggtcccttccctcctcagacacaagccacctcagcttgtggctcttggcccccagccccaccaacccacctgttcatttattcaacagacaatgacagctgatatttattggacatttgcaccatgccaagcattcggcttggattatcccatttgtttctcacagccggtatttattgtctgctcctctgtgccaggtgctgtgctctgggcaggggcactgcatgggctgcctgccctggtggagcttgtggtctgatgggtgaggctgacccaagcccaccccattgccaacagggccagggcaagagtacacacaggggcctcataccatatgtctaaatatttaaaagttatcaatcaagctaacaactgttaaataaaatatgttctattctcct

SEQ ID NO: 26276 - DNA, 2670 bp, Homo sapiens
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 26277 - DNA, 2589 bp, Homo sapiens
atggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 26278 - DNA, 2168 bp, Homo sapiens
gtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtggacgacccaccggagcccgtgtacgcgaacatagagaggcagccccgggccacttcaccgggcgccgctgcagccccccttcccagcccggtgtgggagacgcacacggacgcgggcaccgggcgcccctactactacaacccagacacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcagtgggtgaggctggaggacccccacgggaagccatacttctacaatccagaggactcctctgttcgatgggagctgccccaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactga

SEQ ID NO: 26279 - DNA, 2319 bp, Homo sapiens
gcactgcttagtggacctcatttaatcttcccaataatccagtgaagtgggtgttactatcccattgacaggaaagaaatctgagctgcagagataaggcagaactcccaaggtgccaccaaggctcagacacacagattctcagaggaagtgtggactcacaggtgggcaatgcctagcagaggcaaagatatagaggtaagggagttccttacttactatatcttacaaagatatagaggtaagggagttccttacttactatatcttacaaagatatagaggtaagggagttcctctgaatctgggtggccagattcagcttcccacccaaccctgggtccccaggaggtggtgtcaagagaggccatggcctgggatgcgggcccttcttcctcccagaacactggcctgaatcagccagctcttggcacacacagccaggtccacaggcacaactgttccttggggcccctgagggcagggggtgtgctggggctgtggcttgtaatgtctggagtgagtgcaggctcagatcagggcgaggctgcttgtccagagaggcagaaaattctccaacagaagacccccaaggcggagggccctggggctggactcctggaggttgttctgagcttaccctgtggacggattggagggtggccctccttccccacaaggatcaagagggggtgggggatggtgggagggcaatctggccaggcgaacctgcgggggaggctcccgccctccccagtcccaccatctcagccccgcagcctctttctccctggagacagccaggtgcggcccaggatcccgggaaaggcaggggagggggtggcgtcttcgctcctcaggcgctggcccggcccagaggggacaggaagccaggacaccggggattgtctctcgcaaccgcagcccagccccagtccgggaggaagttctgcccggcgctctccgccggtgcctccctggttatattgttgaacaggaaacccggcagcgcgggagccgcacagtcgaggagggagcgcgggacgccgagcccacgcgcgcctgccggggcaagtggaggcgaagccggcgagcggacgccccgagggtcggggaaggaaccgaggtccggtccccttcttatccagcccgagacatcgagctccggtgggcgtccctgcgctgggaatcccgctcggagtttttccaggcccggccgggctgctccgggaaaggccctgctcctgttccgcgcagcctctccggcctcgcccctggaaaccccgcccagggcgatggtaggggcctaacctgcagccaccgccggctccgcccacccagcccatgggctccctgaggcccgcccagccgacgaaaacgccgcggctgcgatggcggcggacgtggtgggggacgtgtacgtgctggtggagcaccccttcgagtacaccggcaaggacgggcgccgcgtggccatccggccgaatgagcgctaccggctgctgcggcgcagcaccgagcactggtggcacgtgcggcgtgagcccggcggccgccccttctacctgcctgcgcagtacgtgcgcgagctgcccgcgctgggcaaccctgccgccgccgcgccgccaggtccccacccgagccccgcggcccctgagccgctcgcctacgactaccggtttgtgagcgcggcggcgaccgcgggccccgacggcgcccccgaggagtccggaggccgagccagctccctgtgcggccctgcgcaacgcggcgccgcgacccagcgcagcagcctggcgcccggcctgccagcctgcctgtacctgcggcccgcggcgcccgtgcggcccgcgcagtccctgaacgacctggcctgcgccgccgtctcgcctcccgccggcctcctaggaagcagcggcagcttcaaggcctgcagcgtggcgggctcctgggtgtgcccgcggcctctggcgcgcagcgactcagagaacgtctacgaggtcatccaggacttgcacgtcccgccgccggaggagagcgcagagcaggtacctccccgggcgctggggcgcggaggcgggtggcgcgctagggaccgcgcccgcacggagccggggcgcaaggagacccgctccgctcagcgtcgggcacgacgcccacctctgtccgaagacttcggatgagctccctctccccaaccgcgaaacgtgaggggtgcacgcccgcagtccctcatcagcaattcccaagctccaaagctccctggaagcccagaggcttttcgtaatccaattggtggcaaaattgcgcttgaactga

SEQ ID NO: 26280 - DNA, 2296 bp, Homo sapiens
cacgggagttaccacctgggagtcgccctttgaggctgccgagggtgccgccagcccagccacctcccctgcctcggtggacagccacgtgagccttgagaccgagtggggccagtactgggatgaggagagccgcagggtgttcttctacaacccgctgacgggcgagacggcctgggaggacgaggccgagaacgagcccgaggaggagttggagatgcagccgggcctgagccctggcagcccaggggacccgcggccccccactcccgagacggactaccccgagtcgctgaccagttaccccgaggaggactattctcccgtgggctctttcggtgagcccggccctacctctcccttgaccacaccccccggctggtcttgtcatgtcagccaggacaagcagatgctctacaccaaccacttcactcaggagcaggtccctgtccctgcccctcgaagcatccataaatccagccaggatggtgacaccccagcccaggccagccctccagaggagaaggtcccagcagagctggatgaggttgggagctgggaggaagtctctcctgccacagctgctgtgaggaccaagaccttggacaaggcaggggtgctccatcgcaccaagacggcagacaagggaaagcggctccggaagaagcactggagtgcctcctggactgtgctggagggtggcgtcctgacattcttcaaggactcaaagacctcggctgcaggcggcctgaggcagccttccaagttttccacccctgagtacacagtggagctgaggggggccactctctcctgggcccccaaagacaaatccagtaggaagaatgtgctggagctacggagccgagatggctctgagtacctgatccagcacgactcggaggccatcatcagcacctggcataaggccattgctcagggcatccaggagctgtccgcagagctgcccccagaggagagcgagagcagcagagtggacttcgggtcgagcgagcgcttgggaagctggcaggagaaagaggaggacgcgcgaccgaatgcagccgcgcccgccctgggccccgtgggcctggagagcgacttgagcaaggtccggcacaagctccgcaagttcctccagaggcggcccacactgcagtcgctgcgggagaagggctacatcaaagaccaggtgttcggctgcgcgctggccgcgctgtgtgagcgcgagaggagccgggtgccacgcttcgtgcagcagtgcatccgcgccgtcgaggcccgcgggctggacatcgacgggctgtaccgcatcagtggaaacctggccaccatccagaagctacgctataaggtggaccacgatgagcgccttgacctggatgacgggcgctgggaggacgtccacgttatcaccggagccctgaagctcttctttcgggagctgcccgagcccctcttccccttctcgcacttccgccagttcattgcggccatcaagttgcaggaccaggcccggcgcagccgctgtgtgcgtgacttggtgcgctcgctgcccgctcccaaccacgacactctgcggatgctcttccagcacctctgccgggtgatcgagcacggcgagcagaaccgcatgtcggtgcagagcgtggccattgtgttcgggcccacgctgctgcggcccgaggtggaagagaccagcatgcccatgaccatggtgttccagaaccaggtggtggagctcatcctgcagcagtgcgcggacatcttcccgccgcactgactgctggcctgtgactggggcggcggccgcggtcctgccacacaagctgggcggcggaggccacgcagccgggccttcttctctctgggaccctccgccagcgcatagccgcaggccggtgtgacttctgcaccctcggttctgagggtacggtgacccctagtgggcagtttgcaaaatgtgattccttcttcccaactccccatccccccttcccttcccgtcacgtcctgtttgggggttaattcggttttttctctgttgcatcgcgcctactgtgcgtgtgcgatagcgtgtgtgggggtgagagtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagtgtgggctgctga

SEQ ID NO: 26281 - DNA, 5369 bp, Homo sapiens
ctctgtcgcccaggctggagtgcagtagagtgatctcggctcactgcaagctccacctcctgggttcacgccattctcctgcctcagccttccgagtagcttggactacaggcacccaccaccacacccagctaatttttttgtattttttttagtagagacggggttttaccatgttggccaggatggtcttgatctcctgacctcatgatccacctgcctcggcctcacaaagtgctgggattacaggtatgagccaccacgcccggccaggcatttctttatagcaatgccaggatggtgtgccagactgtatcagagacaagtgatacaaagatgaccaagatacagtacttgcccaggaagaagaattcctgtggccacctctgtcttatatcaagagataagtgtgaaacagagtatccacaacagtgtttgggaagacagtgtgagtggctcccaactctaccaacaaaggcttcaaaggagtaatgacatttgaattgagtcttaaaggataaatgtattacttggcctgacaacacagaagaaaaggtcatttttgtcaaagaaatcaaccttgaaaaaatgccgcagttcatgacttgtaccagtgaaggtagcaaggtctgtgtgttggtgatgaatttgcaggggatcaggctgaagaaacaagacttgggagagaggatgtgagacctttttatgacatgcatagagttggcacctcagcctttgcatggtagggagctagctgaaggctacctccatgacagatgtacactttgaaaagacaggccgggtgcggtggctcacgtctgtaatcccagcattttgggaggctgaggtgggcaaatcacttgaagtcaggagttagagatcagcctggccaacacagtgaaacctggtctctactaaaaaaaataaaataattagccaggcatggtggcgcacacctgtaatcccaactattcgggaggctgaggcagaagaattgcttgaacacgggaggcggaagttgcagtgagctgagatggcaccaccgcactccagcctgggcgacagatcaagactccatctcaaaataaaggaagatacagctaatctatatttctttcaccagagatcaccaccactaacaattcatactggtcgtttttccctgaatgttttacctatgtaggaaaattttacatcccaatttttaatttaacactatgaaaagcatttctttttataataaagacactctattagtatacttttgatggcttcaaaactacttttgtatagatgcaaaattaaaatatcaaattgtttcttttgtttgtttgtttttttgttttttttttgagacagagtctcactctgtcgcccaggctaaagcacagtggcatgatctcggctcactgcaagcttttcctcccaggttaaagtgattctcatgccgcagcctcccgagaagctgggactacaggtgtgcaccaccacccccggctaattttttgtatttttacaaaacacaaagagagacggggtttcaccatgttgggcaggctggtctcaaactcctgacctcaggtgatccgcctgcctcagcctcccaaagtgctgggattgcaggcgtgggccaccgtgccctgcctcaaattgtttctttaatggttgttcccaaattttcataaataactttttacgtaacatttttgggcataaagttgtctaaaattattttcataggctagataccttaagtacacttaatgatttaaatcatacttaacattaagactttaatgttgctatattgatatttagtaaaagtacaaaacttgtgctttagagtttagacatattcaggatataagatagttttgttggatttggcgaacacttgccctaggagaataaaaaatgatgaattagtccaaaatgttccagttttctaatttgtcagactcggtaaatggtatcatcaccaaccaagaaaaacagaagatacagggagagtagattttgcagaaaagataaggagttctgtttgggacttgctgcctttgatatactgcactgggagaaaatccaagtcgaacagagtggacaagtgagaatgtgctgtggaatcaacaagaggggtggggagtctacctacctagatttgagagcagtttggcaaataattgttagtaaatgtcatagaaattcgtgggagagagaagttgataagaacagaggggtaaaggatgaaacagaggaaacactgccgcttctcagggttgggtacaagagaagccagggaaatagactaagaaagagtgatcagggaaaccgggagacagtgttgtcacggaagcctggagtgtgagattttccagaaaagaaggaatgaaagaatgaatggtctgtagatccattactcagcactatcagacacattgtccccttttgatatcccataatgaaatttatagataatataatctacttgtgcacaaaattttagaaattaatataatgccccaactataatataaagtgtattagtcagggttctctagagggacagaactaataggatatatatatataaaggggagtttataaagtattaacttacactattacaaggtcccacaataggctgtctgcaagcttgaggagcagagagccaggctgagtctcaacactgaagaacttggagtccgatgttcgagggcaggaaaaatccagcacaggagaaagacgcaggctgggaggctaggccagtctctcctttccatgttcctctgcctgctttatattcactggcagctgattggattgtgcccaccagattaagggtggatctgccttccccagcccactgactcaagtattaatctcttttgacaacaccctcacagacacacccaggatcaatatttgtatccttcaatccaattaagctgacactcagaattaaccatcacataaaggaagaagtaaaaggaaagtatattttatataataagtatttaaatatgtaaacattgggacatgactaaaactgactgaacacattgaaggagtcacttggttggtctgatgtgcagaattaccatgcatgctacaaatggagaggggtctacatgagctgtattgcttgtggtgccgcagatgacttgaatttccagaatgaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaact

SEQ ID NO: 26282 - DNA, 5415 bp, Homo sapiens
acagaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgttcctacagcattctcagtatttctggccctcagcagtgggcattgtaagcatgaactatggaagaggcgccggttcaccaattcaactgaagctttctcatgacttttttttttataaaagtaaaggaaagatgatgtggtccttccagaagaaagaccaatctagaatatggaactctaatcacttctagtatttcaacttcctagcagaaatgaacttggccctagacctagggataagcaatgttctttatgtagccaatgctacgaaacaaaagaggtgaaagagacccttttttatacttaatgtacatatattgactttttgagcaagaatgccagaaatagccttcatttctaccctgcaaaataatccagatctgctttctaaaatgaatcagtttctaaagtgaaacatgcaatatttatgctctgactgactcctgaattggaagaggaagaacttctgtttacagaaaactgtattgttatatatgtcaggctgtgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcatttttaatgtatgggtaattggtggcacatgactttacataatgactttctagactctgaaaaaaatgcttttatcatttttgcaattcagacaagggtaaacattttactttatgtaattgccacatcccaagatgtaaaacggcagtaatttatgaccacgtatggaagaaattcttcaaatagctaccttacatttctgcgtatatatgaaaactgaatgatatttctcagtgtatttccttgcatttgaatggttcaattctgttgtgtttatgtagaaaattcacaaatctgttcatttaattttttaatttgagaatttttatttcttttgactgaaaacacattagaacctatgagtaaattctgaaggttttaagatttacttcagcttgtcaccagtttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatttttagtagatacacagactaatatttgtgtggaggttcttttgaccaattttattcctaagaataaacaaacccctacagttaaaatgcaaagatgcctgtcatctaagtattgaaagaatttttgccttatcaagagttgttttttaaaaatttaataaattcataaaaaagactcatatctttgcaaacaaaagaagggcagatactgggcttctacatgctatccttaagagcttctccccctcacccattcctagtgctcttggtatacacttgggaaaataatgtcctccaggagaaagtgttagagggaactaacattttaggaatgcttattcagaaaaaaatcctagagttgattcattgttttcctccatcctgcaaaagaagatccctttgttaagcagctcacttggaaatatgattcttggagtcaatgatctctaaacaaactggattatcaactatttacaacgtctatacagtataaactacctcacttgcctttcttgggaaaaaaaaaatgaatggactttaacaattgttgttacaaactgtgcctgaatcttattatttaaatcacttcagttagctttcagtgtatgtttaataatatacatttaatgatgaaaaatattttcagcaaagctttaaaaccagaaatactgtgtaactgtgatctatgtggtatactctgagagaattctgtgtcctgctcattgtcttgagtttctaaccatgtgcagatgcaagcgttcaggagtaggaattaatgtccatcttttctttcaggcattttcatctgctgtccacgtatttcacttgactgaaagctcatatgagttaaaatgtcccttcttcctagcgagcatatttcaactgttcttcataaatgtttatgtgccttaaaagactttatgttaaaggattaaatagtttctctgacaggcagtttttaactgttttccacaaataaaaataatatgtcatgggattaaaatgtttgttttcaagcatttttaacagttttacacacttacatacaccttaattaaaaatttttttctgtcagacatttaccaactattttctaaaactaatttgacaaatcatgacactagaaaacgccaatgttttatgtctttgcccatctcaaaagctaatattgattcttctgttccatcagctttcattgttaagtagaatatgtatgttgcattttatccataagaaataaag

SEQ ID NO: 26283 - DNA, 1857 bp, Homo sapiens
caggaagctagcagagtttgcttctgagacgaattctgttacagtacatggcatttatgaggatcaatgtaattatgaatgaattgcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaact

SEQ ID NO: 26284 - DNA, 2314 bp, Homo sapiens
atggaggtggaggactcgggcggcgtggtgctgaccgcctaccactcgtacgcgcgcgcccagccccccaacgccgagtcgcgctgcgcgccccgcgccgcagccagccacccgctcagcagaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaact

SEQ ID NO: 26285 - DNA, 1848 bp, Homo sapiens
acagaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacatag

SEQ ID NO: 26286 - DNA, 5492 bp, Homo sapiens
aaagtaggccagtattgccagagaacaggagaggaggagagtatggtataagcatgtccagaaataaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagggatgtcagagacatttttggagtcagtgaatctcctcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagtcatggttcatcagaatgtattaagattcagaaccaaaggttatatgaaattggaggaaatataggagagcattgcttggatccagatgcttatatattggatgtatatcgtataaatcctcaagcagaatgggtgattaaaccccaacaaagttcttaaaatatcctcgagagagctgctatcatgtattatatgccaaaaagatcctacattttggtagggaaaaaacaacactgtgtttgacgtatttgttcctacagcattctcagtatttctggccctcagcagtgggcattgtaagcatgaactatggaagaggcgccggttcaccaattcaactgaagctttctcatgacttttttttttataaaagtaaaggaaagatgatgtggtccttccagaagaaagaccaatctagaatatggaactctaatcacttctagtatttcaacttcctagcagaaatgaacttggccctagacctagggataagcaatgttctttatgtagccaatgctacgaaacaaaagaggtgaaagagacccttttttatacttaatgtacatatattgactttttgagcaagaatgccagaaatagccttcatttctaccctgcaaaataatccagatctgctttctaaaatgaatcagtttctaaagtgaaacatgcaatatttatgctctgactgactcctgaattggaagaggaagaacttctgtttacagaaaactgtattgttatatatgtcaggctgtgtattgtgactatcagcattctggtgcaaatgaacttttctccatcatcgactgtggaaaattgatacttttaaagcatattcttctatgagcacaggtcctcctagtgaagcttagtttgacaaagggtgtcatatgctttcctaacctgatttgtagttaacattcacagagcctacattttctcattacggttatgatgctcagtatctttccaagtgccaggcacgggcttccttttctgatcaaacataccattttttatatttcacaactatagacagtcacttctgcagtcccaatttaaaaatgcagaactgctttatccaagaatgctgaaaaatactgttctatccaggtttcctaaactataaaagcagattttgcttttgtttgttaatcataggcatggccgagcattgtggattagcctgaggcttaaaatcagatgcatgtctggtaagatgaccactgtctcactatcaagagcctgcagagccattttccagacctgtgattgcccagaacacatagtccccacgtttctaatttggagcaaatctaaaaggtgctgagggattggacagctctgactttcctcgagactatggatatagtccttctcagattagctggaaatggggacagagttctcatttatcccagatatatacattggcttttttggaatctatagattgagattttgatgaatttatattggttttaatgagacccaaatgactctctcttaacaattcaagcagtagacaaagttgctcacaaatacagaaaacatctttttgtctacttcgcaagtctcaaaacgtgataatatttaagcccatttgtagaagaaatcttgtatatactattattacaccttgatatctatacaaaacatcacttgtattaaaatatatagataactttctggcatttagaattttgttccattcatttaatttgttcatctgagaatttttttttttgcctgaaaacccattaaaagaaaacgtgccttctgtataagtttatgtttattcctacattttattcatttttaatgtatgggtaattggtggcacatgactttacataatgactttctagactctgaaaaaaatgcttttatcatttttgcaattcagacaagggtaaacattttactttatgtaattgccacatcccaagatgtaaaacggcagtaatttatgaccacgtatggaagaaattcttcaaatagctaccttacatttctgcgtatatatgaaaactgaatgatatttctcagtgtatttccttgcatttgaatggttcaattctgttgtgtttatgtagaaaattcacaaatctgttcatttaattttttaatttgagaatttttatttcttttgactgaaaacacattagaacctatgagtaaattctgaaggttttaagatttacttcagcttgtcaccagtttcaaataaatccctaataggtaacaagtaaaatacaaattcttgtctactttcatgtggttttaaatggcagggacttcgctgagtcagtaagtataatcactctagtttattcaaggatgtgtggcaactttcaacttccatacgtatatatgtatgtatggaaggccatgtcaatactagtatcattggatataactttgattcttaatcagagggcaaattcattagagaagaatttttagtagatacacagactaatatttgtgtggaggttcttttgaccaattttattcctaagaataaacaaacccctacagttaaaatgcaaagatgcctgtcatctaagtattgaaagaatttttgccttatcaagagttgttttttaaaaatttaataaattcataaaaaagactcatatctttgcaaacaaaagaagggcagatactgggcttctacatgctatccttaagagcttctccccctcacccattcctagtgctcttggtatacacttgggaaaataatgtcctccaggagaaagtgttagagggaactaacattttaggaatgcttattcagaaaaaaatcctagagttgattcattgttttcctccatcctgcaaaagaagatccctttgttaagcagctcacttggaaatatgattcttggagtcaatgatctctaaacaaactggattatcaactatttacaacgtctatacagtataaactacctcacttgcctttcttgggaaaaaaaaaatgaatggactttaacaattgttgttacaaactgtgcctgaatcttattatttaaatcacttcagttagctttcagtgtatgtttaataatatacatttaatgatgaaaaatattttcagcaaagctttaaaaccagaaatactgtgtaactgtgatctatgtggtatactctgagagaattctgtgtcctgctcattgtcttgagtttctaaccatgtgcagatgcaagcgttcaggagtaggaattaatgtccatcttttctttcaggcattttcatctgctgtccacgtatttcacttgactgaaagctcatatgagttaaaatgtcccttcttcctagcgagcatatttcaactgttcttcataaatgtttatgtgccttaaaagactttatgttaaaggattaaatagtttctctgacaggcagtttttaactgttttccacaaataaaaataatatgtcatgggattaaaatgtttgttttcaagcatttttaacagttttacacacttacatacaccttaattaaaaatttttttctgtcagacatttaccaactattttctaaaactaatttgacaaatcatgacactagaaaacgccaatgttttatgtctttgcccatctcaaaagctaatattgattcttctgttccatcagctttcattgttaagtagaatatgtatgttgcattttatccataagaaataaagagaaaaaaactaaaaa

SEQ ID NO: 26287 - DNA, 709 bp, Homo sapiens
attagttcttcacttagagaagaaactccattgccctttgtttctggccctgtgcggctggaggcggccagcactgtcctgtcctggttgaagcaattttaatgtgtgtggggtgctgaatgtgggctggggatggcttccctgcctttgggtcatggggagacacacttgcagaggggttttgtgggtcttcctcaagaatatcatccctgaaatttttaacctgctaaaagaatcaccacttcacatctgtaagcagagcgctggctaactctgtggcttaagcagaggtcagaacatctgaagtgatctgcagatatcctgaaaatccattcctcgctgccgaagaattaacaggatgctctccaatgaatccctccatcctcctgccttcagccgttccaactcagaagcctccgtagacagcgcctccatggaggatttctggcgggaaatagaaagtattaaagacagcagcatgggagggcaagaagagccaccgccagctgaggtcacacctgtggatgaaggagaacttgaagcagaatggctgcaagatgtgggtttatcaactctgatctcaggtgatgaagaggaagatggcaaagccttgctctccacattgactcgaacccaagcagctgccgtgcaaaagagataccatacctatacccaaaccatgaggaaaaaggataagcaatctatcagg

SEQ ID NO: 26288 - DNA, 1859 bp, Homo sapiens
caggaagctagcagagtttgcttctgagacgaattctgttacagtacatggcatttatgaggatcaatgtaattatgaatgaattgcctcgtgatacctgtggcaaccacactaatcagctggatggcaccaaggaagaaagagagcttccaagagttatcaagacaagtggttccatgccagatgatgcttctctcaacagtactaccctgtctgacgcatcccaggataaagaagggagttttgcggttcccaggagtgactctgtggctatacttgagaccattccagttctaccagttcattccaatggatcaccggagcctggacagccagttcagaatgcgataagtgatgatgattttctggaaaagaacattccaccagaggctgaagagctgtcatttgaagtgtcttattcagaaatggttacggaggctctaaaaagaaataaacttaagaaatcagagattaagaaagaagactatgttttaactaaatttaatgttcagaaaaccagatttggcttaactgaagcaggagatctgtctgctgaagacatgaagaaaatccgccatctctctctgattgaattgactgccttttttgatgcctttggaattcaactgaaaaggaacaaaacagagaaagtaaaaggacgagacaatgggatttttggagttccacttacagtcctcctggacggtgaccgaaagaaagaccctggagtgaaagttcccctggtattacaaaaattttttgagaaagttgaggaatcaggtctggaatctgaaggaatttttcgactttcaggatgtactgctaaagtcaagcaataccgtgaagaacttgatgccaagtttaatgctgataaatttaaatgggacaaaatgtgccatagagaagctgcagtaatgttgaaagcgtttttcagagaactacccacctctctcttccctgtggaatatatacctgccttcatcagtctaatggaaagagggcctcacgtcaaagtacagtttcaagccttacacctcatggtcatggcgctgcctgatgccaacagagatgcagctcaggccctcatgacattcttcaataaagtgattgccaatgaatcaaaaaaccgaatgagtctgtggaacatttctacagtgatggcaccaaaccttttcttcagtagaagcaaacactctgattatgaagaattactgttagcaaacactgcggcccacatcatccgcctaatgcttaagtaccagaagattttgtggaaggttccatctttcttaatcactcaagtaagaagaatgaatgaagccacgatgctattgaagaagcagctcccaagtgtcaggaagctgctcaggaggaagaccctcgagcgggagactgcaagccccaagacttcaaaggtactgcaaaaatcaccctcggcaagacgaatgtctgacgtgccggaaggagtcatacgggtccatgctccacttctctccaaggtgtccatggccattcaactcaacaatcaaaccaaagccaaagacatattggcaaaatttcaatatgaaaacagaatactgcactggcagcgagctgcactttccttcctaaatggaaaatgggttaaaaaagaaagagaagagtcgacagagaccaacaggagccccaaacatgtattcctcttcactattggcctggacatctccacataggcagtcatatagagacttgaaatatcattcaagggatttgggtatccagtagacttttagttacatatactacaaaactgactttgtactctcaagtagacctttcgtagaaagaaaatgtttctaataaaaatgtattagaactaa

SEQ ID NO: 26289 - DNA, 6087 bp, Homo sapiens
gctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacacaagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggcccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaaggtgaaattccacaatttgtgtagggatgtcaaatttcagggtttttttgttgttgttgtgttattttgtggtattgtgcttgttttgtgaaagaatgttttgacagggcctcttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaa

SEQ ID NO: 26290 - DNA, 2043 bp, Homo sapiens
gggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtaacgatctttttcttttttatttgcaagttgaattagcggtaatctgccaggagtttggtgtcaaagttctgcgtctgccaagactgcctggaaaggcatgttaaaacatggctaagcccatcccccagagtttctcattcagtaggtcaacattttttaataggctctcaggtcgtgctgatgctgttggtgaagatccacattttgagaaccactatgctgagacctgaattttggagtttgtgaaagaatgtcttagagaaggcagtagtttattttacttgacaagaaagttcaccttttaggcaagtgtgtgtgtgtatgtgtactaattcaggcacctgatagcaaggataggcaaaagctttgtattattgatgaaatgtaattttacgaacaaattctgtaagattatatggaatatagtaaatataaatataaaatgctatttcaaatagaagcaaatattttatagacagtgtactaattataaattgtacatggctgtccattaaaatcaactgcctttgaatcactgaccagaacagattaacttcagaagtattattttgaaaacagaagatttcagaattttcagttatttcaacttagctttactatagtaaatatttgtttaaaatataaa

SEQ ID NO: 26291 - DNA, 4394 bp, Homo sapiens
gttaaggagctgcactgcttcctgccccctaaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggagaaatgggaagttgtacagaaacaagaggctgagggagtcagagaggatgaggacaaaggacagagggagaaggggtaccatgaagcaagaaaagaccaaggagatggtgaagacagcagaagcccagaagcagcaactgaaggaggagcaggggaggtcagcaaggaacgggagagtggggatggagaggctgagggagaccagagggctggagggtactatttagaagaggacaccctctctgaaggttcaggtgtagcgtccctggaggttgactgtgccaaagagggcaatcctcactcttctgagatggaagaggtagccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtattttta

SEQ ID NO: 26292 - DNA, 3482 bp, Homo sapiens
gggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaaccccacagccacctcagccagaggagatggagcctgaggggcagcccagtccagacggctgtctatgcccctgttctcttggcctgggtggcgtgggcatgcgtctagcttccactctggttcaggtccaacaggtccgctctgtgcctgtggtgccccccaagccacagtttgccaagatgcccagtgcaatgtgtagcaagattcatgtggcacctgcaaatccatgcccgaggcctggccggcttgatgggactcctggagaaagggcttgggggtcccgagcttctcgatcctcttggaggaatgggggtagtctttcctttgatgctgctgtggccctagcccgggaccgccaaaggactgaggctcaaggagttcggcgaacccagacctgtactgagggtggggattactgcctcatccccagaacctccccttgtagcatgatctctgcccattctcctcggccccttagctgcctggagctcccatctgaaggtgcagaagggtctggatcccggagtcgtcttagtctgccccccagagaaccccaggttcctgaccccctgttgtcctctcagcgcaggtcatatgcatttgaaacacaggctaaccctgggaaaggtgaaggactgtgattaggaccacagccctgggcaaaggggaccagcaagttgtcttgaatctccagggttcctgactagctgtctcctctgcagcatgagcagctgtagtgcccaactctataggctttggccctccagcttctctctttgactgtgggaggcactgccttggttggtttacctgaacttgtctccgacacaaagcacttatctcttaggagattcccaagaaagtcaacaagatcttgttcccagggagtgggtcattggccaaagggaacataaggtaggcagaaaacttaaaagagtttgttaaagtgaagactggagaaattcctcccttcctctgagctgtgaatctctcttcatgaaagccaaaggtagagacagggaggacagggccaggttagggccttccacacacaaacacttctagagttgcccattcctgttatgttcttggaccctaagatacctcctgtcccttttaaatccagattaagagaaacgtccaggaagagctctttgaagccctcaatatttgttggagggactggactcctctccagctccccaccctctgcctccagtcaccatgtgcaagagaggtcctgtacagatctctctgggctctcctttctcctttggaataacttgttcctatttcaggaaagggaaatggtgtcactcaggccctgggactgcttctccagccaggctggggccacaggtcccactctagtgaaggtcaatgtctcagaataaaagctgtattttta

SEQ ID NO: 26293 - DNA, 2287 bp, Homo sapiens
gcaaagatgctctaacaggaagtgggttaaggagctgcactgcttcctgccccctaaagctgagcggggcgaggagggcgagtgccaggctgggccacgagacacaggacacaatttcttgccagggtcctggtagcttcctcttcaacagccacttccgtgtggccggggccccaggggcaggagctgctgcccgttgcccaggccaccctccacccccaattgggagccctgcccccctggggccgggccaagcccagcagctggctgggatcccatgggggactggtagggcacaggtcttgggggatagaggtgaccgggccagtgccctggggctctggccatgaagtctcggcagaaaggaaagaagaagggcagcgcaaaggagcgggtttttgggtgcgacttgcaggagcacctgcagcactcaggccaggaggtgccccaggtgctaaagagctgtgcagaatttgtggaggagtatggagtggtggatgggatctaccgcctctcaggggtctcctccaacatccagaagcttcggcaggaatttgagtcagagcggaagccagacctgcgtcgggatgtttacctccaagacattcactgcgtctcctccctgtgcaaggcctatttcagagaactgccggatcccctgctcacttaccggctctatgacaagtttgctgaggctgtaggagtgcaattggaacctgagcgcttggtcaagatcctagaggtgcttcgggaactccctgtcccaaactacaggaccctggagttcctcatgaggcacttggtacacatggcctcattcagtgcccagaccaacatgcatgctcgcaacctggccatcgtgtgggctcccaacctgctgaggtctaaggacatagaggcctcaggcttcaatgggacagcggccttcatggaggtgcgggtacaatccatcgtcgtggagttcatcctcacacacgtggaccagctctttgggggtgctgccctctctggtggtgaggtggagagtgggtggcgatcgcttccagggacccgggcatcaggcagccccgaggaccttatgcccaggccactgccttatcacctgcctagcatactgcaggctggcgatggacccccacagatgcggccctaccatactatcatcgagattgcagagcacaagaggaaggggtctttgaaggtcaggaagtggaggtctatcttcaatttaggtcgctctggccatgagactaagcgtaaacttccacggggggctgaggacagggaggataaatccaacaaggggacactgcggccagccaaaagcatggactcactgagtgctgcagctggggccagtgatgagccagaggggctggtggggcccagcagcccccggccaagcccattgctgcctgagagcttggagaacgattctatagaggcagcagagggtgaacaggagcctgaggcagaagcactgggtggcacaaactctgaaccaggcacaccacgagctgggcggtcagccatccgggctgggggcagcagccgtgcagaacgctgtgctggtgtccacatctcagacccctacaatgtcaacctcccgctacacatcacctctatcctcagtgtgcccccgaacatcatctctaacgtttccttggccaggctcacccgtggccttgagtgccctgctctacagcaccggccaagccctgcctctggccctggccctggccctggccttggccctggccccccagatgaaaagttggaagcaagtccagcctcaagtcccctggcagactcaggcccagacgacttggctcctgccctggaggactcgctgtcccaggaggtgcaggactccttctccttcctagaggactcaagcagctcagaacctgagtgggtgggggcagaggatggggaggtggcccaggcagaagcagcaggagcagccttctcccctggggaggacgaccctgggatgggctacctggaggagctcctgggagttgggcctcaggtggaggagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtcctgccctgggactgcttctccagccaggctggggccacaggtcccactctagtgaaggtcaatgtctcagaataaaagctgtattttta

SEQ ID NO: 26294 - DNA, 9317 bp, Homo sapiens
ggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtagaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatgccaaggcagtacctgaagcaccggggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcggcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatattctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagatcttttagactctgacatttatagcatcaccttcaggaacacagttctggggatgtcatcatgagacacactgacagctgtggagatagtccctactctcagctttccttgctagtcaagtccaaaaggccttagaagctgactcaccttctcagccagagtcctgctgctcaagtgtggacctccactttgactctcacccagcctgccagccatcacaaaggctttcataaacttcctgtggtctgggctagcctggcactgatgaaattccattctaaagaaagaaaactcatattcctcccccccacaaattgttcccccaaatgctctgggattacctatttcaccactcatttgagtctccgaaaaatgaactccctgagaatggctggatgggaatcagatagtctgcttccattcaggagagggacagaacaggagctgctgtgtttaggaggatttacctggtgccctagaaagggctatgcaatcaaattctcaagggctccttcaaatcagctatcagtcctcaaaatgggggttgctgatgttaaatgatggatttgcagtgaaacgcatgcatgtactgacgttttctttcagcattagtggttgcttaagaaaatagtaacctatattttctgctacacttggaatatgaagaaatctgaacaagaaccccattaagacacctaacctaatctaaaccctaaaattcaaaatattgtccaagtcaaaagtctagactctgaggacattaaaaatgtaaatatcatcatccttagcaaatatttattgggagcttagtaatagtgcactgggtaccttagcactcccaaatcattcaagagtctagtgaaaaagggggagggatggcagcaaataaaacacccccataaacaaccaggagcaaggttgagaaccattaagttgccaaacaaaagcagaaggggaaaaagtgtggcaacaagcatcttttaataggatagttgacggtattcaagtgacctactgactccaaataatcaaattgaacacaattgcaaatccaatagaacatcccagtgagacactcgggtatttgagaactttgcttgatttagaaaactggaaagtggcaactaggctagaatagtggcaactaggttcggaggtttcgtgtggtcataattggtttggtgaagtgtgagatctctgcaaatgagccaggtaagatcagtattccatagtgcttgaaaaggggattttagagacttctgtcatcacaaagcagattaactcctagttaatgatgaagcagtaggcccaagataaactgttcaattcaagataaattgttcttgtcagtgtttggcatatgataatcacatttggctaaaattggatgggacagtcatttgtctacacaggccttccattcctgcatgaagagatactggggagcatacaattattttgtccagtattagagtgggagaagttctcagtaagtccagtcccaccaggatttatttgggccacattctaccacggccagtccaatctgatgaccacatgaattggggttaagtgttgctaagactatgattttagacatgtctggcaggaaggtcagctcaaaatgtggcatgacaaagaatatgtgctctactaccaaaacctttcctagcaaaacaaggccagaagagggagcaagcatctttccaagcatggagaggagggggcaatggtggaagggtgattgcctgaaatcagtgccagtacagatagcataaaattgggggccaccacagattggctggctactgtgtagatcatttagtaatcttgaggtacattaataatgcagagattacttttctgtgagggtaagggggacgtagctaaatataagaagcttacaaggtccatagccatgtattttactggataaatcacaatgctttgcaataacttaatgtcatagtactttctggcttataattctgcaaagtaaagcactttttcaaagga

SEQ ID NO: 26295 - DNA, 3716 bp, Homo sapiens
tcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtagaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatgccaaggcagtacctgaagcaccggggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcggcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacacca

SEQ ID NO: 26296 - DNA, 9604 bp, Homo sapiens
ctcggtgagcgcgccgaggaagagaggcgagcggagagtggaggaggaggcggcggcggcgggagcggtccccaggaatgtcgctgccgccgccaccgccggggccgctgccgttgaggaggagacggaggagaccgacgttgttaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagcagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaatatgatggaaatcttattaaggagatgtattattgaattttcactgtacctgaaaaggagattcaaaattttttctggggatgtatataggtgaaaatttgattttttaaattatcaggaaaacaagataatgcacagatttctaagactaagatcttacctggatgtgatttttgagctgtggctagacattctttagagccactggaaatattttgaaaactattctagttatagcagagctgctaatattaacgaatatatttgtgtcttcatggtttgtgactattaggccaaattttgtggtatatgttgtcagtctggatctggtgaggtctgttcaacatgaatctttgtgttatcttgaatttagtagtttcaaggtacttaaattcttaacagtttctaatttgtttcaatacatatgggacatggttgatttttttactgtattagaactcttggaagttcttagccttttcaggttatgaaatacctgaaagtaaaattttctaagatttaataagggaagatactattcaaatcattttcttaggatagcatctttacatacaatgagaggattgtacaagcattaatctcatattccaacatccagttacttgatgtgatccaagtaccctggtctttttgaagcagttaaaatctaattaattaactttgggagtcttcactattcaattgatcctcatcattgtcctatttgcatgactccattttttcctccactatatgagttttctttgtcagggggagaggagtgggaagagtcacagaatctcatattcacatcttaattaaattgtgtgaaattagtcttttgtggaaattctgtaggcagtatgattttgaaaagctaaccaatgataattagcattttagttaatactaaatgcataaaattataacccttgaaattaatttggtgctggcagttctggtttagtcatttttaccagtagttagtagtattaagacctgcagtatatgcactttttgagtagctgtcaaataattgtagttgagaaacaacttgtttattctcacaattcagattttctattcagttttgtctcaaatagtaagttattgtgaacaatttaataacggccctcctgttctagtttgcctaatattttagttaagatttagtgttttaacctatttttttaagtttattttttgtattagattttatttgaataagttatgtgggtttagtaattgacctatttattcattgcttcactaattcatccagattagttttaagtgtgtatatgtatttgctcaccagatcattttcttgggaccttgaactgtgaatgttttgtcctaaccatttaatattttctaggtacttgctgcaagttcttgaactattttaccagctttaactttggggctcttagtttcttttctccagattcttgttattttattttatccaaataaatatttaggtgttctaagaa

SEQ ID NO: 26297 - DNA, 4306 bp, Homo sapiens
agagaaatccgtcagcgcgagggagcccgagtggccgccattactgagcccggcgcggcggcgggcgctggggaaggggggagggacgggccgccgctggtggcggggagggagggagggagggtgggtgagctggctgcgggagccgtggggctcagggtttcggggcgtgtgtgtcggggagggcggggggaggtggctgaagggacgcgccgctcggtgagcgcgccgaggaagagaggcgagcggagagtggaggaggaggcggcggcggcgggagcggtccccaggaatgtcgctgccgccgccaccgccggggccgctgccgttgaggaggagacggaggagaccgacgttgttagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaatatgatggaaatctta

SEQ ID NO: 26298 - DNA, 9601 bp, Homo sapiens
ctcggtgagcgcgccgaggaagagaggcgagcggagagtggaggaggaggcggcggcggcgggagcggtccccaggaatgtcgctgccgccgccaccgccggggccgctgccgttgaggaggagacggaggagaccgacgttgttaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttcccccaaacttatctccacttttctatgcattctatcattgatttgacacacttcatagtgagtcatttaaatactctacgtttggttcaattaaccagtaggttacagttattgaaaattaaagtacagtttaaagctcagtctgttacactgaattgattgtgtttgtttttgccaagggtttagatatgcttttaaatattagaaacatctaagaacagaataacataattaaacttttttctggtaagttactggaaggtttcactgtttagggacctatcatatgagacttcttaaaggattaaaagaataggatagtctcataattgtgagtaaacatcaaggcattatattttacaatactgaataaaatttcatctacacacatgttgccattgtttcatttaaggttcagtgcttatagttaactacaatattggacctaacaggatctagattagcaatataaagaagcatagtggtactctgtttcacactttcagtagatttattagaagtcaaattctattcaacagacacttattaggatatacaactaatttaagaataaaattccaggcacaatatattttttttaaatggtatttgttagtagtgcttcttccccttaacatttacagtgtaaatactgcaggtaaccgcaatctaagttagccaaaaagcagctttttttcccatactgtatgtaaataatgtagacctgggtttttttgtttatttgggtttgtttttttttttgaggtactggaatctaattaatatctcttaggtatcaacaaaagggaacaattggaatgagaatttaggccttagcttccatggtgatttttagttttttatacagtaataattgtgatgctatttgtcaactggatataaatacacatataattttaaaaagtcaaaagtgcttttgtttctttgtttaatgtaatttttgtgcttcacctacaggatgctgcagtaaattaaatatcagtgaagcttctgatgtataaagaatgctatgaataaaacattaagaagctgtgtaattttaagttatagttgcctctatttttaccatttcattggtaaaaattagctaatttttttcaagtgaaatgaaaaataaaaatataaatttatcaatatgatggaaatcttattaaggagatgtattattgaattttcactgtacctgaaaaggagattcaaaattttttctggggatgtatataggtgaaaatttgattttttaaattatcaggaaaacaagataatgcacagatttctaagactaagatcttacctggatgtgatttttgagctgtggctagacattctttagagccactggaaatattttgaaaactattctagttatagcagagctgctaatattaacgaatatatttgtgtcttcatggtttgtgactattaggccaaattttgtggtatatgttgtcagtctggatctggtgaggtctgttcaacatgaatctttgtgttatcttgaatttagtagtttcaaggtacttaaattcttaacagtttctaatttgtttcaatacatatgggacatggttgatttttttactgtattagaactcttggaagttcttagccttttcaggttatgaaatacctgaaagtaaaattttctaagatttaataagggaagatactattcaaatcattttcttaggatagcatctttacatacaatgagaggattgtacaagcattaatctcatattccaacatccagttacttgatgtgatccaagtaccctggtctttttgaagcagttaaaatctaattaattaactttgggagtcttcactattcaattgatcctcatcattgtcctatttgcatgactccattttttcctccactatatgagttttctttgtcagggggagaggagtgggaagagtcacagaatctcatattcacatcttaattaaattgtgtgaaattagtcttttgtggaaattctgtaggcagtatgattttgaaaagctaaccaatgataattagcattttagttaatactaaatgcataaaattataacccttgaaattaatttggtgctggcagttctggtttagtcatttttaccagtagttagtagtattaagacctgcagtatatgcactttttgagtagctgtcaaataattgtagttgagaaacaacttgtttattctcacaattcagattttctattcagttttgtctcaaatagtaagttattgtgaacaatttaataacggccctcctgttctagtttgcctaatattttagttaagatttagtgttttaacctatttttttaagtttattttttgtattagattttatttgaataagttatgtgggtttagtaattgacctatttattcattgcttcactaattcatccagattagttttaagtgtgtatatgtatttgctcaccagatcattttcttgggaccttgaactgtgaatgttttgtcctaaccatttaatattttctaggtacttgctgcaagttcttgaactattttaccagctttaactttggggctcttagtttcttttctccagattcttgttattttattttatccaaataaatatttaggtgttctaagaa

SEQ ID NO: 26299 - DNA, 3047 bp, Homo sapiens
agagaggcgagcggagagtggaggaggaggcggcggcggcgggagcggtccccaggaatgtcgctgccgccgccaccgccggggccgctgccgttgaggaggagacggaggagaccgacgttgttagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactagatggtattccttattcacttacattacaaatctaagaccatgtgataagcatgactggagaggtttaatttttataaacaaaaatagctataaagtacaaagctgctgctgcatgcaaccttattgcaatcagtatatcattcctgtggcaatttctgtcaccttatattgtgaataaaatttttctatagaaattaaatgatttaaaaactcacctatatgaaacatttaatgcttttcagcctgctttctggctgattttgttatttgatgtgctaatttgggcaacttaatttacattctggcagtcggtgtagataactaaaagcccagttaagtattttataatttcaggctactgaggccatgcttgggatgttgtttgaaagaaagaaaaaatacacttgacatatttcacatttctgtaccttcatctttacttccaagtaaacccgtggatgatttgatgagggataaatgaacctatttcttttacacacataccaaggacatgcttgtggctaaagtgagttgataatgttgtgcaaaggatagttgtcaccaactcatttctttatggtccataatgaaataaaaattttgtatactgttaattctgtaaacagatgcatgttcaaaagatctatgatggtcttgtaatcttaatctaatatattttagatattttaattttttccctcttggggaacacatttagtatagtgtagaaaatacttccatgacattttcatataaggttatataacttttcatacataaacatgaaatttgttgtagaaaattctttaaaccaaacatttaaatctaggacttcaatttaatttgttccttgaatctatttttatgtggcccttaaaaaatatccaaaaaacccattgctaatatagcaataaaaatactttgggtactgacagactctttggagtgtttatattacaaatttgtattcatattcttttctgtgatgtgttgtactaaaatccaaaatggcttttgcaccatttttaagccaattttttcctttgatgttggtaccagaattactataagtgactgctgcttttgggggtaaacattttgttagtgaagataaaaccagaacactaaattatggataaaattttcagaataggtggcacaggtaaatttcactaggttatattttgtgtagtaaagaaaaaaattatttggtcaatgttatcttaattcatactacaatttaagattatcttatgtgtattatagtaaatagatgattttcagattcaaggctcctaagagtttgatttgctctgttttttcctaaaataaatattgtctctcccaactgttaagttctaggtattgtacttccaattttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagcatcaaactatgtacaggaaaaaagcctgactatttctatttggaagtaggctgaaaagagaattttcaaaactgttcgtgtcttcagttcattctgtcataactttgctattgtaatatgtgaataccagtttatttaagctgttctcttttatactgtattaatttaatgttcatctgcgtttagtaccatttttgttattaaaactggcatttaccgtttttcacattaacccaccttgcaccttccc

SEQ ID NO: 26300 - DNA, 4881 bp, Homo sapiens
ctgcgccgccgcgccgccgctccgcccccggtcgggtgtgtggctgcgcgcgccgggagagatgctgaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagcagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttcagggttcagtagtatacttcatgtttcatacagataattcacattcaaaattacattttctctttgaactaga

SEQ ID NO: 26301 - DNA, 543 bp, Homo sapiens
agcgttattagaaatgcaagagagctggaggctcggggtgtagctgaggttgaaaggtgcacggaacagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaa

SEQ ID NO: 26302 - DNA, 583 bp, Homo sapiens
actttcacagaacgtactgaatcaggggcctgcatccccgtgccgtgccgagccgacggagaaatggactcctcttctcgctcctgtggagtttcgtcttctggtacggtggtttgctcttgagttacgaccagaaaccggaacagaaggaaagggagaagcaggggaggttcggggacgacggcgctccgggcagtaaggcagtagcttccaaagcgtggaggatgggactgaggaggagcagaatacggagaaagagggaagctgaggaaaaatactcacgccaatgggtaaaagggaaaaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttg

SEQ ID NO: 26303 - DNA, 654 bp, Homo sapiens
agcgttattagaaatgcaagagagctggaggctcggggtgtagctgaggttgaaaggtgcacggaagaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggctta

SEQ ID NO: 26304 - DNA, 4824 bp, Homo sapiens
gcgcgcgtcccgtccaggctgcgccgccgcgccgccgctccgcccccggtcgggtgtgtggctgcgcgcgccgggagagatgctgaggaagatgatccctatgatcttgaagatgtttctgcacagaaatgagggaaatacaaagaaccaaatacagttctgaaatttgggatctgtattttgagatgattttattttcagaatgagaagcatatctggttacctttatgaatgtagagacatgagaagagagttatgatggcaaaaaacaaagagcctcgtcccccatcctataccatcagtatagttggactctctgggactgaaaaagacaaaggtaactgtggagttggaaagtcttgtttgtgcaatagatttgtacgctcaaaagcagatgaatattatccagagcatacttctgtgcttagcaccattgactttggaggacgagtagtaaacaatgatcactttttgtactggggtgacataatacaaaatagtgaagatggagtagaatgcaaaattcatgtcattgaacaaacagagttcattgatgaccagactttcttgcctcatcggagtacgaatttgcaaccatatataaaacgtgcagctgcatctaaattgcagtcagcagaaaaactaatgtacatttgcactgatcagctaggcttagaacaagactttgaacagaagcaaatgcctgaagggaagctcaacgtagatggatttttattatgcattgatgtaagtcaaggatgcaataggaagtttgatgatcaacttaaatttgtgaataacctttttgtccagttatcaaaatcaaaaaaacctgtaataatagcagcaactaaatgtgatgaatgcgtggatcattatcttagagaagttcaggcatttgcttcaaataaaaagaaccttcttgtagtggaaacatcagcacgatttaatgtcaacattgaaacatgttttactgcactggtacaaatgttggataaaactcgtagcaagcctaaaattattccctatttggatgcttataaaacacagagacaacttgttgtcacagcaacagataagtttgaaaaacttgtgcagactgtgagagattatcatgcaacttggaaaactgttagtaataaattaaaaaatcatcctgattatgaagaatacatcaacttagagggaacaagaaaggccagaaatacattctcaaaacatatagaacaacttaaacaggaacatataagaaaaaggagagaagagtatataaatactttaccaagagcttttaacactcttttgccaaatctagaagagattgaacatttgaattggtcagaagctttgaagttaatggaaaagagagcagatttccagttatgttttgtggtgctagaaaaaactccttgggatgaaactgaccatatagacaaaattaatgataggcggattccatttgacctcctgagcactttagaagctgaaaaagtctatcagaaccatgtacagcatctgatatccgagaagaggagggtggaaatgaaggaaaaattcaaaaagactttggaaaaaattcaattcatttcaccagggcagccatgggaggaagttatgtgctttgttatggaggatgaagcctacaaatatatcactgaggctgatagcaaagaggtatatggtaggcatcagcgagaaatagttgaaaaagccaaagaagagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggaatcccttctacttaagcatataggatttgtttatcatcccactaaagaaacatgtcttagtggccaaaattgtacagacattaaagtggagcagttacttgctagtagtcttttacagttggatcatggccgcttaagattatatcacgatagtaccaatatagataaagttaacctttttattttagggaaggatggccttgcccaagaactagcaaatgagataaggacacaatccactgatgatgagtatgccttagatggaaaaatttatgaacttgatcttcggccggttgatgccaaatcgccttactttttgagtcagttatggactgccgcctttaaaccacatgggtgcttctgtgtatttaattccattgagtcattgagttttattggggaatttattgggaaaataagaactgaagcttctcagatcagaaaagataaatacatggctaatcttccatttacattaattctggctaatcagagagattccattagtaagaatctaccaattctcaggcaccaagggcagcagttggcaaacaagttgcaatgtccttttgtagatgtacctgctggtacatatcctcgtaaatttaatgaaacccaaataaagcaagctctcagaggagtattggaatcagttaaacacaatttggatgtggtgagcccaattcctgccaataaggacttatcagaagctgacttgagaattgtcatgtgcgccatgtgtggagatccatttagtgtggatcttattctttcacccttccttgattctcattcttgcagtgctgctcaagctggacagaataattccctaatgcttgataaaatcattggtgaaaaaaggaggcgaatacagatcacaatattatcataccactcttcaattggagtaagaaaagatgaactagttcatgggtatatattagtttactctgcaaaacggaaagcttcgatgggaatgcttcgagcatttctatcagaagttcaagacaccattcctgtacagctggtggcagttactgacagccaagcagatttttttgaaaatgaggctatcaaagagttaatgactgaaggagaacacattgcaactgagatcactgctaaatttacagcactgtattctttatctcagtatcatcggcaaactgaggtctttactctgttttttagtgatgttctagagaaaaaaaatatgatagaaaattcttatttgtctgataatacaagggaatcaacccatcaaagtgaagatgtttttctaccatctcccagagactgttttccctataataactaccctgattcagatgatgacacagaagcaccacctccttatagtccaattggggatgatgtacagttgcttccaacacctagtgaccgttccagatatagattagatttggaaggaaatgagtatcctattcatagtaccccaaactgtcatgaccatgaacgcaaccataaagtgcctccacctattaaacctaaaccagttgtacctaagacaaatgtgaaaaaactcgatccaaaccttttaaaaacaattgaagctggtattggtaaaaatccaagaaagcagacttcccgggtgcctttggcacatcctgaagatatggatccttcagataactatgcggaacccattgatacaattttcaaacagaagggctattctgatgagatttatgttgtcccagatgatagtcaaaatcgtattaaaattcgaaactcatttgtaaataacacccaaggagatgaagaaaatgggttttctgatagaacctcaaaaagtcatggggaacggaggccttcaaaatacaaatataaatctaaaaccttgtttagtaaagccaagtcatactatagaagaacacattcagatgccagtgatgatgaggctttcaccacttctaaaacaaaaagaaaaggaagacatcgtggaagtgaagaagatccacttctttctcctgttgaaacttggaaaggtggtattgataatcctgcaatcacttctgaccaggagttagatgataagaagatgaagaagaaaacccacaaagtgaaagaagataaaaagaaaaagaaaactaagaacttcaatccaccaacacgtagaaattgggaaagtaattactttgggatgcccctccaggatctggttacagctgagaagcccataccactatttgttgagaaatgtgtggaatttattgaagatacagggttatgtaccgaaggactctaccgtgtcagcgggaataaaactgaccaagacaatattcaaaagcagtttgatcaagatcataatatcaatctagtgtcaatggaagtaacagtaaatgctgtagctggagcccttaaagctttctttgcagatctgccagatcctttaattccatattctcttcatccagaactattggaagcagcaaaaatcccggataaaacagaacgtcttcatgccttgaaagaaattgttaagaaatttcatcctgtaaactatgatgtattcagatacgtgataacacatctaaacagggttagtcagcaacataaaatcaacctaatgacagcagacaacttatccatctgtttttggccaaccttgatgagacctgattttgaaaatcgagagtttctgtctactactaagattcatcaatctgttgttgaaacattcattcagcagtgtcagtttttcttttacaatggagaaattgtagaaacgacaaacattgtggctcctccaccaccttcaaacccaggacagttggtggaaccaatggtgccacttcagttgccgccaccattgcaacctcagctgatacaaccacaattacaaacggatcctcttggtattatatgagtaggaagtgattgcaaacaggctggatttggacaaaaagcaaatctagacatgcatgtttca

SEQ ID NO: 26305 - DNA, 3946 bp, Homo sapiens
gcctgcctctgttctgaaaggacaggaacttctcaatgatccgatgaaaagattgcatatttttggtcccaagattcacagtagcggaggtctctggcaacaaaaggtatcgtgggagtcacagctatgccagctgggccatttctcagacattcaatatgatctgccatttcaggatgcattttttaccaaaaaaataatttttttaaaacagactcaacttcctactgcaagcttagttcagttagattagagaggacagcaaagacgcggctgattataatttatggggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 26306 - DNA, 5117 bp, Homo sapiens
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaa

SEQ ID NO: 26307 - DNA, 2267 bp, Homo sapiens
ttggagttgtatgatcttcagatcttaggcacaaaaccaccgatgaattccgatacacatcgtaactttgaccccaccgcaacccttagaaatcagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 26308 - DNA, 3632 bp, Homo sapiens
ggctgggctgcgaatagcgtgttcctctccggcggaacacacacacccggccttggggctgtctcctgagctccctcctccacggagagcgctgagcgccgccgggaattccatcccaccgtgggcacgcagtctttggaggtcccgggcgcagcacgctcggtgtccccacactgcagcaagacagagaccccgcgggaaccttgagcttggaacaacccttgagcctctgcagtcggaagagtgggcgcagcagcccagcggaggccaggcgcgcaacctcgggcgccggggcaaggagagagtgcagggaggcgcagctcaggcgcccggctcaggagcgggaggaagttctcgcggcgccgggagcgcggtggacgcgccctgggcgcacgcccaggcagccttctccctggccctcgggactgtcctcgggccgcaaggaggagcttgctggagtcttagaggccatccagagccagcgagcaggagcgctgcgtctcccgcctcagctaggaagggggagtggcgctggcaggctggagctgggaacccagcgagcgcctgaccttcctcctcctcttcctgaccctcttcgcgtcttgggctccggaggaaggttctagcggctgcaggaggtccccagacccattttcctagaaggctggtgatggatctgctgctcctgccgccgccggggcacttggagcgcaccggcggcgcgtgagctgggctttgctctccactgccctgggcaaaccccgggccagccccgcctggcacctttgcctgagtccctttcggttcccgacccaaagccaccagcgtccagggagggaggaggaggtggtcctcaggtgcagccccgccgagatgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaaggtaactggagcctggccagcaggcgctggccaaaacaagcgaccctcctcttgttgcatgtggcatggtgtggggctcttcggaccttctcttcgtctctcccttatttgatgtttctgtaattcaacctgcatttaccgagtacctgctgaacgcctactctaggaagaggaaggtatggcgagcccagtcgttggctgggagggtccctgcaggccacactccaagtctcagatatctgggaaataaacgcatgcccagaggagccactcctattcccagctgattctttttccctccagcatcctaggaactttatgtatactggatttgggttgcatatttgctagtctgaggtgccacccaattactgctgttacatttctaaagaaaacaagctgaacctactatatgtatgaagacaaccttccagaaccaaatagtgttagtatccaatgacaagagagcactatactgggagtcacaaacctgctctgccactttcaacctgcaggatctccagtgagcgattgagcttcccagagtcccatttcctcctgctgtgaaaactcagaatgataac

SEQ ID NO: 26309 - DNA, 2073 bp, Homo sapiens
atgtccgcgcagagcctgctccacagcgtcttctcctgttcctcgcccgcttcaagtagcgcggcctcggccaagggcttctccaagaggaagctgcgccagacccgcagcctggacccggccctgatcggcggctgcgggagcgacgaggcgggcgcggagggcagtgcgcggggagccacggcgggccgcctctactccccatcactcccagccgagagtctcggccctcgcttggcgtcctcttcccggggtccgccccccagggccaccaggctaccgcctcctggacctctttgctcgtccttctccacacccagcaccccgcaggagaagtcaccatccggcagctttcactttgactatgaggttcccctgggtcgcggcggcctcaagaagagcatggcctgggacctgccttctgtcctggccgggccagccagtagccgaagcgcttccagcatcctctgttcatccgggggaggccccaatggcatcttcgcttctcctaggaggtggctccagcagaggaagttccagtccccacccgacagtcgcgggcacccctacgtcgtgtggaaatccgagttggagttgtatgatcttcagatcttaggcacaaaaccaccgatgaattccgatacacatcgtaactttgaccccaccgcaacccttagaaatcagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaacaagttctgtgcttccggctgcagtgcaggcctgcccacagtaccctgccagcatgtttacgccctga

SEQ ID NO: 26310 - DNA, 3883 bp, Homo sapiens
ccggctccgcagcggcagcgggacgctgtgccaggggcgctttgcacagcactcggcacgcacggagcagggctcgcgcccaggggctgccccaggatggcagtgaagtgcggggaactcagagagacaccgtgaccccaggctgagcccaaggcgcgccactcctcccggaggcgacatggggcacccggtgtaccgcggcgagaagccccagctgcactacgcgggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggttcctctggagacatttttgaaagcagctccctaagagcggggccctgctccctttctcaagggaacctgtccccaaattggcctcggtggcaggggagccccgcagagctggacagcgacacgcagggggctcggaggactcaggccgcagcccccgcgacggagggcagggcccaccctgcggtgtcgcgcgcctgcagcacgccccacgtccaggtggcagggaaagccgagcggcccacggccaggtcggagcagtacttgaccctgagcggcgcccacgacctcagcgagagtgagctggatgtggccgggctgcagagccgggccacacctcagtgccaaagaccccatgggagtgggagggatgacaagcggcccccgcctccatacccgggcccagggaagcccgcggcagcggcagcctggatccaggggcccccggaaggcgtggagacacccacggaccagggaggccaagcagccgagcgagagcagcaggtcacgcagaaaaaactgagcagcgccaactccctgccagcgggcgagcaggacagtccgcgcctgggggacgctggctggctcgactggcagagagagcgctggcagatctgggagctcctgtcgaccgacaaccccgatgccctgcccgagacgctggtctgagcccgcacccagccgagccccccctgccccgagccccccgccctccagcccaggggggaccgtgggtggtggccactggcacacttagtgttcttctttcacacttctcaaaagtgacacaagagaaatccagttcacctacagaggtagagcactcacgcccccgccattgagaataaggttccattgcgtagccagccttaggaaaaacaaacagaacccaaaccagatggcaatgtccaatctaaaaacgtccctcttggctctataatataagatacaactcttgcttggtatagcctaaccgtatttatgtgtcttcggttttgactattgtgtattctgtaacagattatgtataatcatatatgatatattcacaaagagaaaacaaaaggaacttttaaaaaaaaaatcacttcacttatattaagcaatgagatatactaaacaatgagattctatagaatgttctagaatgtgcacaagcgggtttctgtgcttttgccatagctttataactggggataacccttccttcgataccaaacactaacaagaggaagcagaatatgagaagccatatttttacataggagtcagatacaaaaagaaaaatcactgaatgcttttagatattgaatacgttttcaggaaaatgctaaatctgatagattacgaaatatatttttagaacttgtttagaaaggattcagttaaccaaacaagaaaaaggcagtgcctcacaaagaaattaagaagttgtccgtcccacgttacatcaaattcagttttatataggccatatataatatatatttataatgtataatttttatgtatttttcaaaactacaaactggaatccaactataaagtgtttaagaatctacacagaatattcaaattatagaacatgttttttccctttgccccataatcagtatttgccaaattacatgcaattccttaaaaactaaatcacatttggtaaaaggcctacagctttgtacttacattgtgccaaaggctgaggaaatgttttctttcgtaattttatgtgtattgtaaaatgttctaccgtactttagtagtttgaagtttttcaagtgcataactatttttgaccagcagatggcgatacgcttcagtattttatgcaattttttttcacttctgaagggaaagtgtattataaaaaaagattttttttttttttataaaacatgctactcttaattttcatgttggtgatgaaattcccagtggtgtttcttaaggttctatcttgtgccatgatgaataaaaagttaagcaaag

SEQ ID NO: 26311 - DNA, 1795 bp, Homo sapiens
ctactctaatcacttccaacgccactatccagcaggacgagatggaggggaatcctagaggaatccttctctagccttcaagtctggggagagcctgccctgttcctggcctggctcacttgggtcgactgttctcatgtacaggatatttggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaacaagttctgtgcttccggctgcagtgcaggcctgcccacagtaccctgccagcatgtttacgccctgacctggagggaccagctaaggaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtca

SEQ ID NO: 26312 - DNA, 2096 bp, Homo sapiens
actcatttgtgcacttactcagggacacagcctgcctctgttctgaaaggacaggaacttctcaatgatccgatgaaaagattgcatatttttggtcccaagattcacagtagcggaggtctctggcaacaaaagggtgatttcacctggaacagcatgtcaggccgcagtgtacggctgaggtcagtccccatccagagtctctcagagctggagagggcccggctgcaggaagtggctttttatcagttgcaacaggactgtgacctgagctgtcagatcaccattcccaaagatggacaaaagagaaagaaatctttaagaaagaaactggattcactaggaaaggagaaaaacaaagacaaagaattcatcccacaggcatttggaatgcccttatcccaagtcattgcgaatgacagggcctataaactcaagcaggacttgcagagggacgagcagaaagatgcatctgactttgtggcttccctcctcccatttggaaataaaagacaaaacaaagaactctcaagcagtaactcatctctcagctcaacctcagaaacaccgaatgagtcaacgtccccaaacaccccggaaccggctcctcgggctaggaggaggggtgccatgtcagtggattctatcaccgatcttgatgacaatcagtctcgactactagaagctttacaactttccttgcctgctgaggctcaaagtaaaaaggaaaaagccagagataagaaactcagtctgaatcctatttacagacaggtccctaggctggtggacagctgctgtcagcacctagaaaaacatggcctccagacagtggggatattccgagttggaagctcaaaaaagagagtgagacaattacgtgaggaatttgaccgtgggattgatgtctctctggaggaggagcacagtgttcatgatgtggcagccttgctgaaagagttcctgagggacatgccagacccccttctcaccagggagctgtacacagctttcatcaacactctcttgttggagccggaggaacagctgggcaccttgcagctcctcatataccttctacctccctgcaactgcgacaccctccaccgcctgctacagttcctctccatcgtggccaggcatgccgatgacaacatcagcaaagatgggcaagaggtcactgggaataaaatgacatctctaaacttagccaccatatttggacccaacctgctgcacaagcagaagtcatcagacaaagaattctcagttcagagttcagcccgggctgaggagagcacggccatcatcgctgttgtgcaaaagatgattgaaaattatgaagccctgttcatggttcccccagatctccagaacgaagtgctgatcagcctgttagagaccgatcctgatgtcgtggactatttactcagaagaaaggcttcccaatcatcaagccctgacatgctgcagtcggaagtttccttttccgtgggagggaggcattcatctacagactccaacaaggcctccagcggagacatctccccttatgacaacaactccccagtgctgtctgagcgctccctgctggctatgcaagaggacgcggccccggggggctcggagaagctttacagagtgccagggcagtttatgctggtgggccacttgtcgtcgtcaaagtcaagggaaagttctcctggaccaaggcttgggaaagatctgtcagaggagcctttcgatatctggggaacttggcattcaacattaaaaagcggatccaaagacccaggaatgacaggaactactcctctccttaacatctcttctcaagaggatcacaggcaaaaagatctaaggctcattttcaagatttacccatgatcatggagcagcactataaatccaaagctactatagaagcattgaaaacaaatataaaaggttcaccttagtctcattttactgagtcacagtaaaccagacttacagaatcatctatttttaaggtgacaattgttcagatagtaccactgatcaatgatcccctaactttttctaaacattttatctaacagtgttttcagtttttt

SEQ ID NO: 26313 - DNA, 1484 bp, Homo sapiens
gggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataat

SEQ ID NO: 26314 - DNA, 1584 bp, Homo sapiens
ggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 26315 - DNA, 1857 bp, Homo sapiens
atgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 26316 - DNA, 1725 bp, Homo sapiens
acgtccggggaggggccaggtgagcggcagacccggcacgcaggtgggggccggcggggtccgtggccagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacaggtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaaccttctaatgaaaactccatgcctctggtccttggactcttgtccatggttcctgagctgtggaccgggatagaataa

SEQ ID NO: 26317 - DNA, 573 bp, Homo sapiens
agacccggcacgcaggtgggggccggcggggtccgtggccaggcatactctaccacctcccgctgggcccaggccttccccttggcacagttggagcagcctctgttatgagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaaagacggggatctcactatgtggcccaggctggtctcgaactccaagctcaagcgatcctcccacctcagcctcccaaagtactgggattacag

SEQ ID NO: 26318 - DNA, 581 bp, Homo sapiens
ccagggcgtgtacggggacaaggggccgctggccgggcatactctaccacctcccgctgggcccaggccttccccttggcacagttggagcagcctctgttatggtcttatttttctccctccatggtgctggacactggatgggcacttggtgtacaaccgagagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagct

SEQ ID NO: 26319 - DNA, 2043 bp, Homo sapiens
atgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaa

SEQ ID NO: 26320 - DNA, 2573 bp, Homo sapiens
caaacccaaacagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattt

SEQ ID NO: 26321 - DNA, 2653 bp, Homo sapiens
ctccctgtttctgtcttgaacctgattctttcttcttatctccttcctgtgtccacctcaagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggttagatgggtggaggcccggagggaggctccgaccggccgggaccaagggagtggggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttttctgatgc

SEQ ID NO: 26322 - DNA, 2597 bp, Homo sapiens
ctccctgtttctgtcttgaacctgattctttcttcttatctccttcctgtgtccacctcaagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttttctgatgca

SEQ ID NO: 26323 - DNA, 2912 bp, Homo sapiens
gctggaagcaacagatggggactgcagaggaggtggtggtattgggatagtgctgcagccaagaacttaacgactgaaagtaactgggatatcttcataattatctgaaggtcacagtgggagaacaaaattaaaagaactgagaagacttacaagagaacctcctaagagtcacccaaacaatcggctgagaatgagaagaggttcaagtgattcttgtgcctcaggctcccaagtagctgggactacagtagctgggccagcacacccagaaagcctcacattgtgcagtggagaagctgagagaagaggaaaagaggagtggccagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggttagatgggtggaggcccggagggaggctccgaccggccgggaccaagggagtggggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttt

SEQ ID NO: 26324 - DNA, 2461 bp, Homo sapiens
ctccctgtttctgtcttgaacctgattctttcttcttatctccttcctgtgtccacctcaagactcccaccactacccaggaccaactcctgctcctgaatcttctgatgggccccacaaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttttctgatgc

SEQ ID NO: 26325 - DNA, 2569 bp, Homo sapiens
acatacttcctcaccagacaccaccaggagttctcagcccccaaaacctgtcaccgatcctcaccaggctgtttgctctaccctctcccccaactcaagggctcccgtcctcacctccctgcaacactgctcctagaaccatgtctgtctacctggagacagccaggcctattcccttctgggtctccagtgtccctttttctcacaggtgacagtgctggctacaatgctatccagccggtggtggccaagttcctgggggatcctagggctgggcccccgaagccctcctcggggatcccagctctgtgccctctatgcctttacttatactggggcagatggccagcaggtgtctctggctgaaggggataggttcctactgcttcgaaagaccaactccgactggtggttggcaagacgcctagaagctccctccacctctcgacccatcttcgtcccagcagcctatatgatagaggaatccatcccttcccagagtccaactaccgtcatccccggccaattgctctggactcctgggccgaagttgtttcatggttccctggaggagttgtctcaggccctcccaagcagggctcaggctagctcggagcagcctcctccacttccccgcaaaatgtgtaggagcgtcagcactgacaatctgagccccagccttctgaagcctttccaggaaggaccaagcggaagatccctctcccaggaagacttgccgtcagaagccagtgccagcacagcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattttt

SEQ ID NO: 26326 - DNA, 2323 bp, Homo sapiens
gtgctcttccttcctccagactcctagcccagggcagggtttttctgtgttctgcttgcctgataggctacagcaggtctcctctagagatgtgacttgcccagcccttccctctctttcttaaccgtgggtggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggt

SEQ ID NO: 26327 - DNA, 967 bp, Homo sapiens
ggctcctcttcccttctgtagacccttctctgtcttcttttaccttgcaggatgtgagggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagctcctggacgacccccatgaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggctggatcgggagaaccccctggagctgcgtctgtcgggctctggacccgcggagctgagcgccggggaggacgaagaagaggagtcggagctggtgtccaagccgctgctgcgcctcagcagccgccggagctc

SEQ ID NO: 26328 - DNA, 563 bp, Homo sapiens
gttctgcttgcctgataggctacagcaggtctcctctagagatgtgacttgcccagcccttccctctctttcttaaccgtgggtggaaaggggctcctcttcccttctgtagacccttctctgtcttcttttaccttgcaggatgtgagggtggggcacccccttcaacattccccccaccccacaaaaagcctgttcccctttcctgtggccctgaggtgggggtggggtgggggaggcgggaagttggcaacaggaagtgaggagaagagcaaagaaaactgtgagagagagaatttttaaaaagcagctggggcctgaggtttctcccccagtaccctgggtcacctcagcccagagctggcggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccg

SEQ ID NO: 26329 - DNA, 722 bp, Homo sapiens
gggaaggagacacggtgcccagctttttgcggctctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggctggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtatttt

SEQ ID NO: 26330 - DNA, 624 bp, Homo sapiens
ctttccaggaaggaccaagcggaagatccctctcccaggaagacttgccgtcagaagccagtgccagcacagtgagtcacagctcttctgagctgggccctgttctaggcacaggacagacagcacctctgtcttcaggggactcccctggggatgacaaacacaaaaacaaataaataagataacgcttggtactactgataagtctaaaggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacgcacctcgcagcttgaccctccagccttgcaggcccctcgacctctgccgcagc

SEQ ID NO: 26331 - DNA, 2028 bp, Homo sapiens
gagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagaggtgcccaggctggggtgcaggggcgggaggtgtggcttactgggcgctggtgggtgggtgcagggtcaccgctgccatctgtgcctgcctgtcccaggctcttgctccccatgctcctctgctgctctctgggtctggccattcctctcccttcttctttccttttctcatctccctcctgcttcctcattgcccccctttccttttatccttcctttttcctctgctccttcctctccttccttttttcactaatccttctcctcctcccttcctctccaccactccttccatctcctttatttcctcccccctcctctctcaccttccccctcctctctttcctccccactcctctctcacctgggttttctttccccaccttccatccccctccgatctccctgccacttttcattttttcagcccttcccccttctctttcaagcccccctgccccctgccccccaccccccgcctcgctcctgcctcctggtgcccgtccctcaaccccccacccctctgctctgtgccctgggggccctgtcccccttacagctggggggcaggctctgcctcctgcccgtccttgtgccgctgctttggggaccctttggtgggtgcggggaggtgggtcaggttccatctgggcccacctctgaccctgtgcccctctctccccagaaggtggaagaggtgggtgcctgggccctgggtgggggaagggctagcccctcccccatttctcccagcccctcccctctccccatggccactccctccccttcactccctgtga

SEQ ID NO: 26332 - DNA, 3231 bp, Homo sapiens
ggtggactcagggcggctagagcgacgcggcggcaggggtggggagagtgcggagcccgagcgcggaggcttcggttccggtggcggcgatggcttctctttccacctggagcagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatct

SEQ ID NO: 26333 - DNA, 3107 bp, Homo sapiens
agagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatct

SEQ ID NO: 26334 - DNA, 3206 bp, Homo sapiens
agagccaggaagcgggagccgggacccagggcccgggatcgccgagcccgacctcgggcgccccgccggtcacctccgcgcggacaccagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctgctttgctgtctgcatgccgacatgctgggctcactgggccccaaggaggccaagaaggccttcctggacttctaccacagcttcctggagaagacagcggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaagtgctgtccctgaagcagcttctgtttccggcggaggaagacaatggggcggggcctcctcgagatggggatggggtcccagggggcggccccctgagcccagcacggacccaggaaatccaggagaacctgctcagcttggaggagaccatgaagcagctggaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatct

SEQ ID NO: 26335 - DNA, 2886 bp, Homo sapiens
ggcggcgatggcttctctttccacctggagcagccctgcagagcccagggagatggaagacttcgcccgaggggcggcctccccaggcccctcccggcctggcctggttcccgtcagcatcatcggggctgaggatgaggattttgagaacgagctggagacaaactcagaagagcaaaacagccagttccagagcctggagcaggtgaagcggcgcccagcccacctcatggccctcctgcagcacgtggccctgcagtttgagccaggacccctggttctccgggtgccggtccctcccaacgtcgcctttgaacttgaccgcactagggctgacctcatctccgaggatgtccagcggcggttcgtgcaggaggtggtgcaaagccagcaggtagccgtgggccggcagctggaggacttccgttccaagcggctcatgggcatgacgccctgggagcaggagctggcccagctggaggcttgggttgggcgggaccgagccagctacgaggcccgggagcggcacgtggcggagcggctgctcatgcacctggaggagatgcaacataccatctctaccgacgaagaaaagagtgctgccgtggtcaacgccattggcctgtacatgcgccaccttggggtgcggaccaagagtggagacaagaagtcggggaggaacttcttccggaaaaaggtgatggggaaccggcggtcggacgagcctgccaagaccaagaaggggctgagcagcatcctggatgccgcccgctggaaccggggagagccccaggttccagattttcgacacctcaaagcagaggttgatgccgagaagccaggtgctacagaccggaagggaggcgtggggatgccctctcgggaccggaatatcggggctcctgggcaggacacccctggagtctctctgcaccctctgtccctggacagcccagaccgggaaccaggtgctgacgcccccctggagctgggggactcatccccgcagggcccaatgagcctggagtccttggcgcccccagagagtaccgacgagggggccgaaaccgagagccccgagcctggagatgagggggagccggggcggtcgggactggagcttgaaccagaagagcctcccggctggcgggaactcgtccccccagacaccctgcacagcctgcccaagagccaggtgaagcggcaggaggtcatcagcgagctgctggtgacagaggcggcccacgtgcgcatgctgcgggtgctgcacgacctcttcttccagcccatggcagaatgcctgttcttccccttggaggagctgcagaacatcttccccagcctggacgagctcatcgaggtgcattccctgttcctcgatcgcctgatgaagcggaggcaggagagtggctacctcatcgaggagatcggagacgtgctgctggcccggtttgatggtgctgagggctcctggttccagaaaatctcctcccgcttctgcagccgccagtcatttgccttagagcagctcaaagccaagcaacgcaaggaccctcggttctgtgccttcgtgcaggaagctgagagccgcccgcggtgccgccgcctgcagctgaaggacatgatccccacggagatgcagcggctgaccaagtaccccctgctcctgcagagcatcgggcagaacacagaagagcccacagaacgggagaaagtggagctggcagccgagtgctgccgggaaattctacaccacgtcaaccaagccgtgcgtgacatggaggacctgctgaggctcaaggactatcagcggcgcctggacttgtcccaccttcggcagagcagcgaccctatgctgagcgagttcaagaacctggacatcaccaagaagaaattggtccacgagggcccactgacgtggcgggtgactaaggacaaggcagtggaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccgatcacaaagccttctacgtcctttttacctgggaccaggaggcccagatatacgagctggtggcacagactgtgtcggagcggaaaaactggtgtgctctcatcactgagactgccggatccctgaaagtccctgcccctgcctctcgccctaagccccggcccagcccgagcagcacccgagaacccctcctcagcagctctgagaacggcaatggtggccgagagacgtctccagctgatgcccggaccgagagaatcctcagtgacctcctgcccttctgcagaccaggccccgagggccagctcgctgccacggcccttcggaaaggagttggaggaggaattttgccgcctgagacccctcctgtctcagcttggggggaactctgtcccccagcctggctgcacttgaggttcccgcccaggaaggccttttgcaagaaggagaggaatgggggagaggacgtgagggaccacccccacccacacagctgccgcagcatctcacaccccgagggcctgaggagagggagctgtgggccacgcctgggaggggcccagctggggttactggccccgcatgagcctcggccatctctccctcctgccctctgcttgggggactcagggctccattctggagggcaccacggtgacccgggccatctcagtattgcctgtgggggccacccctccacccccacccccaagtgccttcgctctgtttttataccctgaattggaggtttattttttaatatatattatct

SEQ ID NO: 26336 - DNA, 5393 bp, Homo sapiens
atgagacctccaggatttctcagcagagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttatttt

SEQ ID NO: 26337 - DNA, 5590 bp, Homo sapiens
ggggtcgcgggggacgcgggggacgcgggggacggcggggaacggcgggggacggcggggaacagcgggggacggcggggaacagcgggggacggcggggaacagcaggggactgcgggtcgcgtcctggccgccgaggagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttatttt

SEQ ID NO: 26338 - DNA, 1996 bp, Homo sapiens
gaacggcgggggacggcggggaacagcgggggacggcggggaacagcgggggacggcggggaacagcaggggactgcgggtcgcgtcctggccgccgagcatttatttgctggctttagcagccaacatcggcagttacggatgcataactctttatagacagatgagacctccaggatttctcagcagagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaaatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaaggttgagagaggttttcttcaactctattccaaaattatttttgctttgtgctaa

SEQ ID NO: 26339 - DNA, 5480 bp, Homo sapiens
atgagacctccaggatttctcagcagagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaagcaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttatttt

SEQ ID NO: 26340 - DNA, 5648 bp, Homo sapiens
gaacggcgggggacggcggggaacagcgggggacggcggggaacagcgggggacggcggggaacagcaggggactgcgggtcgcgtcctggccgccgagcatttatttgctggctttagcagccaacatcggcagttacggatgcataactctttatagacagatgagacctccaggatttctcagcagagctccttcccttaacagagctgagagaggcatctggagctgcagcatggaccagcgagagcccctgcctcccgctcctgcagaaaatgaaatgaaatatgataccaataataatgaagaggaagagggagaacagttcgattttgacagtggagatgaaatcccagaagcggacagacaggccccatccgcccctgagacaggaggtgctggagccagtgaagcccctgcacccacaggaggtgaggatggagctggagcagaaaccaccccagtggcagagcctactaagctggtgctcccgatgaaagtcaacccatattctgtcatcgacatcacgccattccaggaggaccagccgcccacccccgtgcccagcgctgaggaggagaatgtgggtctccatgtgccctgcgggtacttggtgcctgtaccctgcggctatgcggtgccctccaacctgcccctcctgctgcccgcctactccagcccggtcatcatctgcgccacgtccctggacgaagaagcagaaacaccagaagtcacagaagatcgccagcccaattctctgagttccgaggagcctccaaccagtgaagatcaagtcggtcgagaggacagcgcacttgcccgctgggccgcagacccggccaacacagcctggatggagaatccagaggaagcaatttacgatgacgttccaagggaaaactcagactctgaaccagatgaaatgatttatgatgatgttgagaatggggatgaaggtggaaacagctccttggaatacggatggagttcgagtgaatttgaaagttacgaagagcagagtgactcggagtgcaagaatgggattcccaggtccttcctgcgcagcaaccacaaaaagcaactttctcatgacctaacccgtttaaaggagcactatgagaaaaagatgagagatttgatggcaagcacggtgggcgtggtggagattcagcagctcaggcagaagcatgaactgaagatgcagaagctcgtgaaggccgcgaaggacggcaccaaggacgggctggagaggaccagggcagccgtgaagaggggccgctccttcatcaggaccaagtctctcatcgcacaggatcacagatcttctcttgaggaagaacagaatttgttcattgatgttgactgcaagcacccggaagccatcttgaccccgatgcccgagggtttatctcagcagcaggttgtaagaagatatatactgggttcagttgtcgacagtgaaaagaactacgtagatgctcttaagaggattttggagcaatatgagaagccgctgtctgagatggagccaaaggttctgagtgagaggaagctgaagacggtgttctaccgagtcaaagagatcctgcagtgccactcgctatttcagatcgcgctggccagccgcgtttccgagtgggactccgtggaaatgataggcgatgtcttcgtggcttcgttttctaagtccatggtgctggatgcatacagtgaatatgtgaacaatttcagcacagccgtggcagtcctcaagaaaacatgtgccacaaagcccgcttttcttgaatttttaaaggaacaggaggccagccccgatcgaaccacgctctacagcctgatgatgaagcccatccagaggttcccacagttcatcctcctgctccaggacatgctgaagaacacctccaaaggccaccccgacaggctgcctcttcagatggccctgacagagctcgaaacactagcagagaagttaaatgaaagaaagagagatgctgatcaacgctgtgaagtgaagcaaatagccaaagccataaacgaaagatacctgaacaagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacgcccctctcatgacagccgtgtgatgagcagccagaggtacttgctgaagtggagcgttccactgggacatgtggacgccatcgagtatggcagcagcgcaggcacgggcgagcacagcaggcaccttgccgttcacccgccggagagcctggccgtggttgctaacgcgaaaccaaacaaagtttacatggggccaggacaactgtatcaagatttacaaaacttgttgcatgacttaaatgtaattggccaaatcactcagctgataggaaaccttaaaggaaactatcagaacttaaaccagtcagtagcccatgactggacatcaggtttacaaaggcttattttgaagaaagaagatgaaatcagagctgcggactgctgcagaattcagttacagcttcccgggaagcaggacaaatctgggcgaccgacgttctttacagctgtgttcaatacgttcacccctgccatcaaggagtcctgggtcaacagcttacagatggccaagctcgccctagaagaggagaaccacatgggctggttctgtgtggaagacgatgggaatcacattaaaaaggagaagcatcctctcctcgtcggacacatgcccgtgatggtggccaagcagcaggagttcaagattgaatgtgctgcttataaccctgaaccttacctaaataatgaaagccagccagattcattttccacggcacatggtttcctgtggatcggaagttgcacccatcaaatgggtcagattgccatcgtctcgtttcaaaattccactcccaaagtcattgagtgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccagatggatcctgggattcagaacctcaaaaagtgatcaagttaggcgtcctaccagttagaagtctactcatgatggaagacacgttgtgggcggcttccggaggtcaagtcttcatcatcagtgtggagactcatgctgtagagggtcagctggaggcccaccaggaggaaggcatggtgatctcccacatggccgtgtccggcgtcgggatctggattgccttcacctcagggtccacgctccgcctttttcacacggaaactctcaagcacctgcaggacatcaacatcgccacccctgttcacaacatgctgccagggcaccagcggctgtcggtgacgagcctgctcgtctgccacggattgctgatggtcggcaccagcctgggagtcctcgtggccctgccggtcccacgtctgcaagggattcccaaagtgaccggaagaggcatggtctcctaccatgcacacaacagtcctgtcaaattcatcgtcctggccacggctctgcacgagaaagacaaggacaaatccagggacagcctggctcctggccccgagcctcaggacgaagaccagaaggacgcacttccgagtggaggagctggttcatctctgagccagggtgaccctgacgcagccatctggttgggagattcgctgggatcgatgactcagaaaagcgacctgtcctcctcatctgggtccctgagcttgtctcacggctccagctctctagagcacagatcagaggacagcaccatctatgatctcctgaaggatcctgtctcgctgagaagcaaagcacgccgggccaagaaagccaaggccagctcggcgctggtggtctgtggagggcagggccaccgccgggtgcacaggaaggcccggcagccccaccaggaagagctggcgccgaccgtcatggtctggcagatccctctgctgaatatataagcaggacggccgccttctgctgtcagaatttgcaatcaagggtgacttctcagctaatcctacagcctgagtggttaagctgtgtctacactggttgggaataaattaaaaacagtatttgggggagaaacgtgcaatagcgtaatggtggtgtccctgccaattccttccttctcttctgtacagcagaagtaattacaagcacttctcacgaaggcagaagactgatgcaattttcgagtaattgagtgcagttctgggaaaataccacattctttttgactgctgtagtccatatgtgaatactaaatgttaaacttcatcagcgtcagacctattgtatcatattagagaatttgcagactaagaatttatgagaaaatatatgtattcagtagtgcaggcatttattaacaattcttaaaagttttacctgattcagattcacgacttttatttatattctatatttttgaatttcagagtaaaatttgttaacaattttaaaagccaggtaacacctaccagtccagttagcatgatttgctttcagaagtgagctgggttttccaaagtggtataatgtgtgtactgtatattttaacaaagtaatatttttgtattgcatttttctattaaaaaattaacagttaatgtttcagtcaatgtattatctgtagcatttcacaaataatgtttgctttgaaccaaaatgctcagtgcctatcaacatttggactcaagcatcaacaccaaattattcctcccttctcgtataaatagagtgactatccacaggagaaaagtgtgtgctttagtattagaggagataggcagagaagtcttgcttagttccttcgtgcagcttcttgcccctgttgacgtggaatgctgtgtctgctttagcacgcacgctccgaatgactcctggtgctaggccatgctggctgctgtcactgagcgggactcaggccaagaggcgtgacctcgggccagcctgtctgttgtgcagacgcctcctctgcagaacgcatcagtttctattctgcagttgcagagccagccccgcgtgagaacgtgcataatgagtgcacaccatcatgtcaaggtgcatacttagtgagcgccatcctgctgaacgtgtatttcagtgtttcacttactggacggataacaagaaaaaaatcctaacacaggcaggcaccagaaataaatgtctcagcactttacagatgactaaaaatgttaattttatgacttagccaaatatgttctaggttgcatatatcccccatgtgaaagtgatttcttcccaagcttctcaaactgttagctgctgtctgacttcatcaataaagtatttttattttaaaatgca

SEQ ID NO: 26341 - DNA, 3443 bp, Homo sapiens
atgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttgg

SEQ ID NO: 26342 - DNA, 4488 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 26343 - DNA, 3685 bp, Homo sapiens
attaatagccgtggcagggctcgaatcacaggccaagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgg

SEQ ID NO: 26344 - DNA, 4035 bp, Homo sapiens
gtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctg

SEQ ID NO: 26345 - DNA, 2007 bp, Homo sapiens
acaggctctctgtctgctcttcttttgcagacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaaaggcacgtggtcagacatgtaaggtgtctaagacctgtggacagctgaccgctgaccaggtggagtcacagcctgcagaggctctgccgggcacaaagccagaggctcctggagccaggctggggagcgtggctcagccaccctgg

SEQ ID NO: 26346 - DNA, 3363 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccagacaggtcattaataaaatgttctccaagagcctga

SEQ ID NO: 26347 - DNA, 4376 bp, Homo sapiens
gcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttgg

SEQ ID NO: 26348 - DNA, 3232 bp, Homo sapiens
aagaatgttacccagcagctcgtgggggaagaggaagctgcgaggcaggctggggtgggtgcggagtgatgcccggggcgtgatgtgggcccggcaggagggtctgcaccacccccacccccacgccgtcatccgctgtccctcctcctcctcctcctctgtctcctgctcaggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccctgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctggacttgg

SEQ ID NO: 26349 - DNA, 9444 bp, Homo sapiens
ggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacaggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 26350 - DNA, 9660 bp, Homo sapiens
gttgaccccttacagtcggatggtctagatgactgaatggagttttgagttggacttttgtgtccctgacggagttgggcctgatcccagagcactgggggtggggaggaggtgttactgtaaaatgcaagttggataaaaggaggacctctcgccaagggccccaatgagtggcacacagtctactatcaccgacaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgggctggagtacagacaggtgatcgaatcatcaaggtgaatggaactctggtgactcattcaaatcatctggaggtggtgaagctaatcaaatctggttcctatgtagctctcactgttcagggacgcccacctgggtcgccccagattccacttgccgactctgaagtagagccgtcagtcattggacatatgtctcccatcatgacatctcctcattcacctggagcatctgggaatatggagagaatcactagtcctgtgctcatgggggaggaaaacaatgtggttcataaccagaaagtagaaattctgagaaaaatgttacagaaagaacaggaacggctacagttattgcaggaagattacaaccgaacacctgcccaaagattgctaaaagagatccaagaggccaagaaacacattcctcagctgcaagagcagttatccaaagccacaggctctgctcaggatggagctgtagttacaccctccagacctttaggggacaccctaacagtcagtgaggcagaaacagatcctggagatgtactgggcaggactgactgtagcagtggagatgcttctcggcccagtagtgacaatgcagatagtcccaagagtggcccaaaagagagaatttatctagaggaaaacccagagaaaagtgaaacaattcaggacactgacactcaatcacttgtcggaagtccctcaacccgtatagcacctcatattattggagcagaagatgatgattttggtactgaacatgaacagatcaatggacagtgcagctgtttccagagcattgaattactaaaatctcgcccggctcatttggctgttttcttacaccatgtagtttcacaatttgaccctgcgactttgctctgttatctctattcagacctgtataaacataccaattccaaagaaactcgtcgcatcttccttgagtttcatcagttctttctagatcgatcagcacacctgaaagtttctgttcctgatgaaatgtctgcagatctagaaaagagaagacctgagctcattcctgaggatctgcatcgccactatatccaaactatgcaagaaagagtccatccagaagttcaaaggcacttagaagattttcggcagaaacgtagtatgggactgaccttggctgaaagcgagctgactaaacttgatgcagagcgagacaaggaccgattgactttggagaaggagcggacatgtgcagaacagattgttgccaaaattgaagaagtattgatgactgctcaggctgtagaggaagataagagctccaccatgcagtatgttattctcatgtatatgaagcatttgggagtaaaagtgaaagagcctcgaaatttggagcacaaacggggtcggattggatttcttcccaaaatcaagcaaagtatgaagaaagataaagaaggggaagaaaaagggaagcgaagaggattccccagcatcctgggacccccacggagaccaagccgtcatgacaacagtgcaattggcagagccatggaactacagaaggcgcgccaccctaagcacttatccacaccctcatctgtgagtcctgaacctcaggactctgccaagttgcgccagagtgggttagcaaatgaaggaacagacgctggatacctgcctgccaattccatgtcttctgtagcttcaggggcctctttttcccaggaaggagggaaagagaatgatacaggatcaaagcaagttggagaaacatcagcacctggagacaccttagatggcacacctcgtactctcaatactgtctttgatttcccaccacctccattagaccaagtgcaggaggaggaatgtgaagtagaaagggtgactgaacatgggacaccaaagccctttcgaaagtttgacagtgtagcttttggagaaagtcaaagtgaggatgaacaatttgaaaatgacttagagacagatccacccaactggcagcagcttgttagtcgagaagtgttactgggactaaaaccttgtgaaatcaaaagacaggaagtgattaatgaattgttctacactgaaagagctcatgttcgaacactgaaggttcttgatcaagtgttctatcagcgagtatccagagaaggaattctgtcaccctcagagctacggaaaattttttcaaacttggaagatattcttcaacttcatattggattgaatgaacaaatgaaggctgttcgaaagagaaatgagacctctgttatcgatcagattggggaagatttgctgacatggttcagcggaccaggagaggagaaattgaaacatgctgctgctaccttttgcagtaaccaacctttcgccctggaaatgatcaaatctcgtcagaaaaaggattctcgatttcagacttttgtgcaagatgctgaaagtaatccactgtgtcgtcgtcttcaactgaaggatattattcccactcaaatgcaaaggcttactaagtacccacttctgttggataatattgccaaatacacagaatggccaacagaaagggagaaggtgaagaaagctgcagatcactgtcgtcagatcttaaattatgtaaatcaggctgtcaaggaggcagaaaacaagcagcgcctagaagattatcagcgtcgccttgatacctccagcctgaagttgtcagagtacccaaatgttgaagagctcaggaatttggatttaacaaaaaggaagatgattcatgaagggccattggtttggaaggtgaatagagataaaactattgatttatacacgttgctgctggaagacattcttgtattgttacaaaagcaggatgatagactggttttaaggtgtcatagtaagattctggcatctacagctgatagcaaacacacgtttagccctgtcattaagttgagtacagtgttggttcgacaagtggcaacagataacaaagctttattcgtcatttccatgtcagacaatggcgctcagatttatgaactggtggcacagacagtttctgaaaagactgtctggcaggacctaatctgtcggatggctgcatcagtgaaggagcaatccacaaagccaattccattaccacagtcaacacctggcgaaggagataatgatgaagaagatccttcaaaattaaaagaggagcagcatggcatttcagtcactggtttgcagagtccagacagagatttgggattagaatctaccttaatatcgtcaaaacctcagtctcattcactgagtacctctgggaaatcagaggtacgtgatctgtttgtggctgagagacagtttgcaaaggaacaacatacagatgggacactaaaggaagttggagaagattatcaaatcgcaatcccagattcacacctgcctgtctcagaagaacggtgggcattggatgcactaagaaatttgggtttgttgaagcagttgctggtgcaacagctaggtttgactgagaagagcgttcaggaagactggcaacatttcccaagatacagaacagcctctcaggggccgcagacagacagtgtcatccagaactctgaaaatattaaggcctatcattctggtgaaggacatatgccctttagaactggaactggtgacattgcaacttgttacagtccacggacttcaactgaatcttttgctccacgggattcagtgggactggcaccccaggatagccaggcaagtaacattttagtaatggaccacatgattatgaccccagagatgcctaccatggagccagaagggggtcttgatgacagtggagagcacttttttgatgcccgtgaagcacatagtgatgagaatccatcagaaggtgatggagcagttaacaaggaagagaaggatgttaatttacgcatctcaggaaactatttgatccttgatggctatgacccagtgcaggagagttccacagatgaggaggttgcttcctcacttaccctgcagcccatgacaggcatccctgctgtggaatccacccaccagcagcaacattctcctcagaatactcactccgatggggcaatttcaccattcacccccgaatttctggtccagcagcgctggggagctatggagtattcctgttttgagatccagagtccctcctcttgtgcagattcacagagccagatcatggagtacattcataagatagaggctgaccttgaacacttaaagaaggtggaggaaagttacaccattctttgccaaaggctggctggatcagccctcacagacaagcactcagataaaagttagagccgcatgtcctggaggtgactgcaggttgttggatttggagtatcggccgtgtctcaccacatcctggctccagtgtggatgcagagagagtgtgacagaggatctgcctgtgaaccacctgggattagtcaagtcccaaggtgcccagagtgggactagttcttcacagtgtggcagctgcactaatctgtttgtgagggaatatccattccctcactctactctcctcactatcggaaattcattttgattcagaataaaaaccaaatgtatagagctttgggtgtaggatatgaaattgtacttagatttaagaaaaagagaaaatcagatgtatttatttgacttcattccgtatttgaaagcacattttaatttttatttgccttgttttgttttaattgagtagtgagagttttagacctttgtctttagtacacccaaggatcaactgctcctgaagcaaagaggtcaggatggagtatgcagaagttgggtagagaggttaagaagaggaggaagtgagacggggaagggaggagcaccttgcttcactatacagtattccaagctctctgctgtccagtaggctgcttctctgagggtcacctcaaaggtatgctatgccgtgtggctcttatgtgcccaggtggtgtggtcagagagtggatgggcttcctcccgccctgaggcaagcacctcttctctgtagctgggatcaaccacaattaataggaatcctcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaatgggattaaaaattttagaagcagaagctaatatataaatgaagtttgggatttggaactttctgtatctcttaggaggaacaagtaaaaaccaaatggttacattgtgctgctagaaataatgtcattctcaattaaaagggttacacctgtagccacttgacactaacaccatcgagggcaattaatcaggagaaaagtaaatataaaaactttgctcttaacgtcacacactacagggtaattatgtaattctctagcactcaattaagaagcttgtaggttagcaaaatttcagtttctctagttcagccagtgtcttgtccttagtaattatttgctttccctgcagttcaatttctccttggaactctaacaggactaactggaaaaatactttgaccatagctctagtacttccaaataaattcatatctagattttcaaacaaagccccaagatgaagtctaattctgaaaatatctcacaatttttgaatgttctttttatcttaccgacctaacttctcttttccctcccaacttggcctcccacacgttccatttcattttggccattatagtcacatccgtttgactttggttgtgacatcttcctttcaggatgatggaattagatgcagtctgtctttgagtgagactggtcaccatcagaggagttttttctaagtgacgtgactagaagttgaaatctacttccctgctaaagggcacaggggtggtgtacaaagaaagctaccttcccagagcaagcaggctgcattttagctatggaagtgacctgctgtgacactgtgctctcttctgtgggcttaatggttcctttgctatgaagtggcaaattacatgtagagtgtctccttccttttcagagaacagttaatcaaggcaaatcagcaagcccccaaagtgctgtaatttaacatcatgattaccaccttcgaagctatatattttgcatactttaaaatcacctaacttggactgcttgaattacattggcttttagaaccgaaattgtaactatgtattgtatttcatgggaggtatattttatgagctttttggctttcttttttcccacagcaactgccaatgaaggatgaatcccctttttaaaaagttgttgttgttgttgtttatttgattttgagttaggagggataatagagaagtccatttaaaaattatttttagaagctaaagaaagtaattatgcttcctgtgaattgtcttttactggcatctttgttttcctctttgatgttagtaaatttggtgtaatacgtggggcttccatatttcaaagtggaagctttcttctctgaagtcgatatatggttttgaattactagagctttggtcagtatttccttccctatatgtcacagagggcaccactgagaactgcgtgcataggacctcaaaatacaaaattagcagggcctcacagtcagcttcctcatggctagtttttcccccttatattacaatttttgttttataagtcatttttttcctgatatttccaccacttttcagagtcatctacaaaatttttctttcctcaagaaaagagttccttttgccttattccttatgccttccccactggtattgagggttttgataataaattggtaggaaaaaaaagtacctcctagaaggaagccttccccaccatttccaggtgccaactgctaagcagatatattccaaaaatggtaactgtcatgtgcacactgttggttatttttaataagcctcttcctactagaacattttattttccttgttcaccatacaatcatgtactctttaacagaaattgcttttaaaaaatatctggaactatctttaaaaaaactttattaataatcatgtatttttactgatcacattttgaaatgcctaaaagactttattgttctaattatccagatgtacctttgtaaaatagctcttttatgaattagctgataaggctgtatgtttctggaacaaaatattggtcatctaaaaactttctgttttctggggtctgggaaaatagaaaataagatttcaaatattaaataagcttaaaggaaccaagcatgtgactttttatttgtattctggttgatttgtcttgtccaagttatattagaaaagttgaggagtcgaggagcctgtaattaattttcctgtcagtgactgtcagacatcttcctgcttattagagcatccctagcaacaaggctaaaccttcatgacagtgctggcaggtgggcttgccctagcatgtggggcaggtttgttgtttttttaatagctttattgagatattcacatatcatataattcatccatttaaagtgtataatcagatgggttttggtatattattgatttttaattgtggtgaaatatatatataacaaaatttgctattgtaactatttttaagtataaagttcagtgaggtaggccagcttttatgacgcacctgaagataactttggttttaatcctaccctaaatgaagcatatgcctctatttttcctgtccccagtgctgggcttcttcacataccaacatttctgtgcttttaccaacagcattttagctcagaaggctcgcttactttgggcatttgctgtattttggttttgaaatacttgtaatttgacttattcttgggataatattttagttttcagtcattcaagggcacatttggctgacggagctaataagcgtaataaaatgcttagtagtttataccatcttttagttaaacattttaaagattaagactattcaaatgtactttgcggaaattaacctgtttgtatgcctggctttgtttacaaacatatatctatatctatatatatagatacagatacagatacatatctggtggaacaaagaaatacctgtaccattcccacttgctctttgatagccacctcctaggaatggagacaataaaactctgtatttgcatgtg

SEQ ID NO: 26351 - DNA, 3029 bp, Homo sapiens
ctgacatgctgacatcgccccctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggagctagggaagtttgccgttttcgtccatgccaagatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgccttt

SEQ ID NO: 26352 - DNA, 1712 bp, Homo sapiens
ctgacatgctgacatcgccccctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctccagcccccaggaggacaaggaggtcatcagtga

SEQ ID NO: 26353 - DNA, 2165 bp, Homo sapiens
acccaggagcttgccttgctcggctctggggccatgctgacatgctgacatcgccccctgaggacttggctgcaaccccagagcccccagggtgtcccggagccctggaccgtgctggcagctggacggagctccctggctgagggccaggtgggtggcagagcaaaagaggaatggactgtgggccacctgctaccctccagccccacctgactgggccacctggcactgcccaccaccctgtagcagtgtgccagcaggagagtctgtcctttgcagagctgcccgccctgaagcccccgagcccagtgtgtctggaccttttccctgttgccccagaggagcttcgggctcctggcagccgctggtccctggggacccctgcccctctccaagggttgctatggccattatccccaggaggctcagatacagagatcaccagcggggggatgcggcccagcagggctggcagctggccacactgtcctggtgcccagcccccagctctggagggaccctggagtccccgacacacacagccacagcgccgggccagccacggctcggagaagaagtctgcctggcgcaagatgcgggtgtaccagcgtgaagaggtccccggctgccccgaggcccacgctgtcttcctagagcctggccaggtagtgcaagagcaggccctgagcacagaggagcccagggtggagttgtctgggtccacccgagtgagcctcgaaggtcctgagcggaggcgcttctcggcatcggagctgatgacccggctgcactcttctctgcgcctggggcggaattcagcagcccgggcactcatctctgggtcaggcaccggagcagcccgggaagggaaagcatctggaatggaggctcgaagtgtagagatgagcggggaccgggtgtcgcggccagcccctggtgactcacgagagggcgattggtccgagcccaggctagacacacaggaagagccgcctttggggtccaggagcaccaacgagcggcgccagtctcgattcctccttaactccgtcctctatcaggaatacagcgacgtggccagcgcccgcgaactgcggcggcagcagcgcgaggaggagggcccgggggacgaggccgagggcgcagaggaggggccggggccgccgcgggccaacctctcccccagcagctccttccgggcgcagcgctcggcgcgaggctccaccttctcgctgtggcaggatatccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgccttt

SEQ ID NO: 26354 - DNA, 582 bp, Homo sapiens
gaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctgtagggctgggggctctgaaaggggcgggggcgtggagggagtctcaggcaggtgtaggcactgagggctgggtgacgtaag

SEQ ID NO: 26355 - DNA, 921 bp, Homo sapiens
ggcgggatcgaggacaggaaaggcttgcacaatttcccgcggcgggacgtgggtcgccgggcccgcccggcgccagattaggagtggggctagagaaggggcgaggacgcgaggtgtggcgtcctggggtctggggatgtgaggccagggcctccgaggtgaactggtcctgccctttcgaccccgtgtgtgccctccctcaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaagg

SEQ ID NO: 26356 - DNA, 3602 bp, Homo sapiens
cactcggctccggagcccagtcgagtcctgcccggctagaagccggctgtcggtctccgtgtcgccgccgccgcccggcatcgtggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacccccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatc

SEQ ID NO: 26357 - DNA, 3639 bp, Homo sapiens
agcccaggggagccgccgccgcagccgccgccgccgcggtgagttttccagcctggagaggccgaaccagcgcgggggtcgaggagacctgagcctgccatactgagtctatggacagttccacagcaatgaatcaatgcagctgtagaggaatggaagaaaacaaggaaaggcctaaacggcagcggcaaaacaactttcccatgtttccctctcctaaagcctggaatttcagagggcgaaaacggaaacagagcacccaagatgaagatgctgttagcctttgcagtctcgacataagtgagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcatc

SEQ ID NO: 26358 - DNA, 3992 bp, Homo sapiens
gcagaagagctgtcagatctttcccttcagcacttaaatcattgtcacgcaatggctttcatcttgggagattcatcctctgcattttggaactgagccttcctagtgttctgagagttttctgctgtctgttcagcttagcacgctaagaagctggagaggtacccagcagcctggttgcattctccgtcttggaaaagtatttaactgctttgagaaatcatggaatcgtttctggccacattgtgagattgtattgaattttctttttaagtttttaaatttttatatgcaaatgctggaaagcttggagacagtctatttcaaagaaggctgttgatttctgagactggcaggggcataaaatgacatgagagtgtctcagcaggattccaaattcacgaaagatttttccaggcacctactatgttcagaacggggatgcagaaatatcctggagaatctgaagttctgccttaaccctcgaaactttgaaagcaatggctgaaaaggaaagatgaatacctagaggctccctctggaaatgattgaggtttgccaccacaattggctactttggctttgcccatcaaaatttggtatcttcatgtgctgtctagcatctactacaggtcagatggagcttaggaggacaagggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtggaaacagcaggcacggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaaggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtc

SEQ ID NO: 26359 - DNA, 3656 bp, Homo sapiens
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaa

SEQ ID NO: 26360 - DNA, 1872 bp, Homo sapiens
tagagagaggaaatgaggccagatgggcagcaagctttggatgctgtggtaaggagttttgactgtcactctgaagcagctctcaggcagaggaatgatgtgatttattgtagtttaccaaggaccgctcagggtattgtgcagagggaagaccagctggaggttcttgtgtcactccgtgaagtgtgggggcggcggaggggcagagatgggacctgcactggagccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtga

SEQ ID NO: 26361 - DNA, 4257 bp, Homo sapiens
agaaaaaactcagggcaaggttggccttggctcataagaccttttcaaactttattgagtcaatagttctagagaaagagaacacccatgaacgttccccaagttctcccaagggcgagaaggagaagagcaggctgcgccagggttcctggcgggcgtttctgaaaagcaaagatgccggaagccccaaaaagcccaccctagtgagtctgcctctaggacccgaagttctctccccagcagagaccgacagccactgtgaggaacgggcggaggacaaagagggctatgtttttagcgatcactgggcacccccacttgcctccacacctttgtcctccagtttagtttctccagaacacaggaggaaaagtgaaccgaccatcaagtgcacagccacccaggaaggcgacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagtaacctggctgct

SEQ ID NO: 26362 - DNA, 1893 bp, Homo sapiens
atgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtga

SEQ ID NO: 26363 - DNA, 1638 bp, Homo sapiens
ccacttgcctccacacctttgtcctccagtttagtttctccagaacacaggaggaaaagtgaaccgaccatcaagtgcacagccacccaggaaggcggtaggtacctaccttcaggtatctttccggaaaagtcctggctggcgtcccccggcagccctcgggcccagcaggctggaatcgcacacaccctgccttccagctctgcctgctgcctggcatatgaaaaccccgggacgccctgcagacccacgagccccaagcccctgagtcccaggcctagtgctcagcggatgggtctccactaccccgggaggggtagcgccatctccatggtttctcttggaagctacagctacgtggacagcagttcaggggaccctgaaagacccaagattcccaagggccagaccagtttcctgctttctctgcagacgctaaaccaagatgagcagaaggaagagagcagggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaat

SEQ ID NO: 26364 - DNA, 3800 bp, Homo sapiens
gggaaggaggccagggtccgcgcggcttgggcacagtgccctggctcagggaccttcctgggagtgagaaccacatgccctgggaagaaccagcaggtgagaagcccagttgctctcacagtcagaaggcgttccacatggagcctgcccagaagccctgcttcaccactgacatggtgacatgggccctcctctgcatctctgcagagactgtgcgtggggaggctccttcacagcctaggggcatccctcaccgctcgcccgtcagtgtggatgacctgtggctggagaagacacagagaaagaagttgcagaagcaggcccacgtcgaaaggaggctgcacataggggcagtgcacaaagatggagtcaagtgctggagaaagacgatcattacctctccagagtctttgaatctccctagaagaagccatccactctcccagagtgctccaacgggactgaaccacatgggctggccagagcacacaccaggcactgccatgcctgatggagctctggacacagctgtctgcgctgacgaagtggggagcgaggaggacctgtatgatgacctgcacagctccagccaccactacagccaccctggagggggtggggagcagctggctatcaatgagctcatcagcgatggcagtgtggtctgcgctgaagcactctgggaccatgtcaccatggacgaccaggagctgggcttcaaagctggggacgtcatcgaagtgatggatgccaccaacagagagtggtggtggggccgggtcgccgatggcgagggctggtttccagccagcttcgttcggctgagggtgaatcaggacgagcccgcggatgacgacgcccctctggccgggaacagcggagcggaggacggcggggcggaggcgcagagcagcaaggaccagatgcggaccaacgtcatcaacgagatcctcagcactgagcgggactacatcaagcacctgcgcgacatctgcgagggctacgtccggcagtgccgcaagcgcgcagacatgttcagcgaggagcagctgcgtaccatcttcgggaacatcgaggacatctaccgctgccagaaggccttcgtgaaggccctggagcagaggttcaaccgcgagcgcccacacctgagcgagctgggtgcctgcttcctggagcatcaagccgacttccagatctactcggagtactgcaataaccaccccaacgcctgcgtggagctctcccggctcaccaagctcagcaagtacgtgtacttcttcgaggcctgccggctgctgcagaagatgattgacatctccctggatggcttcctgctgactccggtgcagaagatctgcaagtaccctctgcagctggccgagctgctcaaatacacgcacccccagcacagggacttcaaggatgttgaagccgccttgcatgccatgaagaacgtggcccagctcatcaacgagcggaagcggagacttgagaacatcgacaagattgctcagtggcagagctccatagaggactgggagggagaagatctcttggtcaggagctcagaactcatctactcgggggagctgactcgagttacacagcctcaagccaaaagccagcagcgaatgttctttctctttgaccaccagctcatctactgtaagaaggacctgctccgccgcgacgtgttgtactacaagggccggctggacatggacggcctggaggtggtggacctggaggacgggaaggacagagacctccatgtgagcatcaagaacgccttccggctgcaccgtggcgccacaggggacagccacctgctgtgcaccaggaagcccgagcagaagcagcgctggctcaaggcctttgccagggagagggagcaggtgcagctggaccaggagacaggcttctccatcactgaactgcagaggaagcaggccatgctgaatgccagcaagcagcaggtcacagggaagcccaaaggtaggcggacagcagccccacctcctcggctgcccggtccttaccctgctgacatcattcccttctctgaaccacaaagccaagccagctagccaccaggcctgaggggggcccactgccctttgcagctgtttgttcccaaaggttggtaataaggggccactggggaagcctgggtcagtatatggttgacattcttactctcaacaccttggctcccccagatcagggccattggtgacaatgcttgtttccccagggttccttcctgacaggcatctggggttggtgtagggatggagctgctttccccatttctacagagagccatgcccctgaaacatcacatgcctttgcacaggccacccccctcttcaggctgctgcaggaggccaggcccaggccagagaccccaggcagcctgagctcttggatgtggtcagctctccaggagcaagtcctgtgtggcaaaactgcctcctacggcggctctgaagcagagccctgggacggaccccatgctgtccccaacagctggggtggcactctgccctgggcacccatgaccctctgctgtctctccctgttcagctgttggccggccctgctacctgacgcgccagaagcacccagccctgcccagcaaccggccccagcagcaggtcctggtgctggcggagcccaggcgcaagccatctaccttctggcacagcatcagccggctggcacccttccgcaagtgaactggtccctgcctgacagcacctgctgggccttcctgccagtggcccccagtttttcttccccgaggcccactcggcctggccttcctctgcctgcaagtgagcagggatgggctggggagttgcttgtgccaccaagacgtgccaggtctgtactcctgttgtctttttccctgctcctggtgccctgaagagaccagcaagggggcagaccccgcactcgccacaccgccgctgcagcttgggccccatccgccctctggacctgtgtagggcctcactgctggagcggggaaaccgcagctcagcccaggcccagctggggagaaggcgctacctgcgtgggaccctcttctctggaaacctaatcctcctttcatttcctctgggcaggactctctggccttctgtggcctgcaatgccaggccatgtgcccctctgccctctagttctccaagtccccagcccggccagtggtgccaggcagcttgccacttgggagggcagaagccaggaattccacacccttgtgttgcgcccggagcccgcccttcgcctcccagcccctcaagacaccgctggctgctggacaccctcttcacttgtgtgtgtgtgtgtagcggaaaaggacaagacggtgcagtcggctgcatactcccagtcgggagtgtggtcagtctgcctgctgctgtgcggtagctccagaaccacctcgttcctggttttgtttggattttggcatcttgtttttctaacaacaaacaatggagaaaaagaattgattcttagtgacacagaagattgccttacgctcgtgagcgtgagaagccataagagagagaccgaattctgtggctcagcacacaggactgacccacagcccaggcagcgggtgtgtggagatggcgccctgtcctgccaaggggcgccaggagcagagccagggcctggcgagctggcgtggagcccacaggattcagcagcatggacagtcactcttgcactattccttctccaagccagaaaccacatttaatttcataaataaatttatgaaaagt

SEQ ID NO: 26365 - DNA, 5544 bp, Homo sapiens
gaaacttcctaggagaacccgatccctccctcccgtcgggcggccaggggcgggccgcgggtggggcggccgggcctgcgctggggacggctctggggactgcggccggcgccgggacctggaggggacgctggggccgaagcagcatgtgacaccgaccaggattcagccctgatggaggctgaggaggcccagcgtggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggctctgaaagtgggactatcaggcagggggaagagctgccacctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaatagggcggactctcaggacgaaaagagtcaaacctttttgggaaaatcagaggaagtaactggaaagcaagaagatcatggtataaaggagaaaggggtgccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcatgactcagattcccgggactcagacagagtccagggctgaggaactgtcccccgcagctctgtctccctcgctagagcccatcaggtgctctcaccagcccatttctctactgggctcctttttgactgaggagtcacctgacaaggaaatagatcaaaacagccagcaagaggaatccaggctgaggaagggaacagtgtccagccaagggactgaggtggtctttgccagtgcatctgtgactcctccaaggacaccagattcagctcctcccagtcctgctgaagcctaccccatcacacctgcctcggtatctgccaggcccccagttgcctttcccaggagggaaacctcttgtgctgcacgtgctccagaaactgccagtgcccctctctcaatggatgacccatctccctgtgggacttctgagatgtgcccggctgccctctatggcttcccctccaccgggaccagccctccgaggcccccagccaactccacaggcaccgtccagcacttacggagtgactccttccctggttctcacaggacagagcagactccagacctggtgggaatgttgctttcctactcccactcagagctgccccagaggccccccaaacctgccatctacagctctgtgaccccaagaagggacagaaggagtggtagggactacagcaccgtttcagcatcccctactgccttatccacgctgaagcaggactctcaagaatccatctcaaatctagagagacccagcagtcctcccagcatccagccctgggtctccccacataatccagcctttgccacagagtctcccgcctacggttcttccccatcctttgtctccatggaggatgtgaggatccacgaacctctgccccctcctcccccacagaggagggacacccatccctccgtggtggagacagatggccatgctcgtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagta

SEQ ID NO: 26366 - DNA, 2937 bp, Homo sapiens
gtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagt

SEQ ID NO: 26367 - DNA, 2432 bp, Homo sapiens
ctaccactccctggactccggagctccagggacccacctctaaggatgaagcaggggtctcagaacaccctgaggcccctgcgagagaacctttgagaaggacaacccctcagcaaggagccagtggcccagggaggtcacctggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagta

SEQ ID NO: 26368 - DNA, 2968 bp, Homo sapiens
gtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggaactaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagaaagtgaaaagcttcggtggatctcagccttggccatgccaagagaggagttggaccttctggagtgttacaactccccccaggtacagtgccttcgagcctacaagccccgagagaatgatgaattggcactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagt

SEQ ID NO: 26369 - DNA, 2958 bp, Homo sapiens
atgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaa

SEQ ID NO: 26370 - DNA, 4077 bp, Homo sapiens
gggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 26371 - DNA, 4149 bp, Homo sapiens
gagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggcgagcaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcca

SEQ ID NO: 26372 - DNA, 4073 bp, Homo sapiens
gctgggcagtgcccatgctgggatgtgctgctgctgtggctgctgcccgctgctggcccacctagagcaggggtcacttcgagagaggacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 26373 - DNA, 4435 bp, Homo sapiens
acattgtaggggctgctggccatggaagggcactgtctctctgctttgacaatggtccccttgaacaagttcctttagctctggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtacccgtgagtggcatcaactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaagatgtgctagtgctgctgatgacagatgtactggtgtttctccaggaaaaggaccagaagtacatctttcctaccctggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacatgcccatccagggaggacttccccctgattgagacagaggatgaggcttacctgcggcgaattaagatggagttgcagcagaaggaccgggcactggtggagctgctgcgagagaaggtcgggctgtttgctgagatgacccatttccaggccgaagaggatggtggcagtgggatggccctgcccaccctgcccaggggccttttccgctctgagtcccttgagtcccctcgtggcgagcggctgctgcaggatgccatccgtgaggtggagggtctgaaagacctgctggtggggccaggagtggaactgctcttgacaccccgagagccagccctgcccttggaaccagacagcggtggtaacacgagtcctggggtcactgccaatggtgaggccagaaccttcaatggctccattgaactctgcagagctgactcagactctagccagagggatcgaaatggaaatcagctgagatcaccgcaagaggaggcgttacagcgattggtcaatctctatggacttctacatggcctacaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacagcccagccgaggcactgaccgcctggatctacctgtcactactcgctctgtccatcgaaactttgaggaccgagagaggcaggaactggggagccccgaagagcggctgcaagacagcagtgaccctgacactggcagcgaggaggaaggtagcagccgtctgtctccgccccacagtccacgagactttaccagaatgcaggacatcccggaggagacggagagccgcgacggggaggctgtagcctccgagagctaagggggcccctcccccctgccccgtgccccactgaagaacattactgagggggctaaccttggggactccaatttgccaatgatgagggaacatttgaaagaactgcaaattgtccttgccagctcttgggatccttggatacctggggccatttaagaagctaggggaattaggccacaacaccccctgggacatccgaaagctacaccacagatgccagtggttcatgccttcttcccgcaactttaggaaaatttatttatttattgtttattagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactcc

SEQ ID NO: 26374 - DNA, 2074 bp, Homo sapiens
agtttgggtctgggctgtgcttatgccaacaggaagggctgggctgggggcaagcaacagggctgggctgaggcgaggcagtgttcctccctggtgcccgtcactggccactggatacagacggtagtggtggcgatgtgtgtttcaggaggagactgcaagcatcgggatgcccaggccccaaggaggccctcttcctgcagatccgagaaggactggacacctttctgggactgcagcaccagggtggctacgcctcccggctggatcaggattcctgtcatccatctgctggccctttggaccactcggccactggcatgctttccaagtctgtacccgtgagtggcatcaactgtctcttggaccgttcggatacagatgggaatgtatcccagtcctctgccattgacctcaggaaacgctgcagccagctggaaggacattcaggtacccgggtaggctcctccctgcgacagaccttcagcttcctctcgggcatgaccggaaaggccaagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagaga

SEQ ID NO: 26375 - DNA, 1774 bp, Homo sapiens
agacacatggaaggccttcggtaaaagtggagaatcccaacctagtcccccaaagtagctggcagaggcggagctaggaggagggcagagtggggtcaggaaggccccagaagggtggggcatgtgggagaattctctcctctctgttcttcgacctctgggagtgaatcctacccttcccgtgtactgaagatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtaaagacaccctcgccaactgtaccaaggtcaagcagaagcaacagaaagcggccctgctgaagaacaacaccgccttgcagtccgtttctcttcgaagtaagacaaccatccgggagcggccaagctcggccatctacccctccgacagcttccggcagtccctcctgggctcccgccgtggccgctcctccttgtctttagccaagagtgtttctaccaccaacattgctggacatttcaatgatgagtctcccctggggctgcgccggatcctctcacagtccacagactccctcaacatgcggaaccgaaccctatccgtggaatccctcattgacgaagcagaggtaatctacagtgagctgatgagtgactttgagatggatgagaaggactttgcagctgactcttggagtcttgctgtggacagcagcttcctgcagcagcataaaaaggaggtgatgaagcagcaagatgtcatctatgagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccagttctcaggtcctagtgcggagcagatgtgtaagacctactcggagttctgcagccgccacagcaaggccttaaagctctataaggagctgtacgcccgagacaaacgcttccagcaattcatccggaaagtgacccgccccgccgtgctcaagcggcacggggtacaggagtgcatcctgctggtgactcagcgcatcaccaagtacccgttactcatcagccgcatcctgcagcattcccacgggatcgaggaggagcgccaggacctgaccacagcactggggctagtgaaggagctgctgtccaatgtggacgagggtatttatcagctggagaaaggggcccgtctgcaggagatctacaacctcttactgctgttctccctttctccgtccttcatggaagccctgggagataacctggcttcctggagttgatggaataaaggttggggtggccataatggtttgttgggggtgaggg

SEQ ID NO: 26376 - DNA, 8292 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctcaaaaaaaaaaaaaaaaaaaagtcatctaatatttcgatgaaggaaatagacatttttcattgattccctctgatgtcagttagagatatttaaaaagttagatccccataatagatactattgtggaaactgaagagtagctactggcctactgatagactgaaactggttttgttattcttaacgttctccagtctgcactctgctgtgctgtctgtgctcagactagacgtgcatgccgtttcctttgcaggtgtgttctgcagctctggttttgggggatagctcttttttaagtaagattaaaaaatgaaaaatatataaatttatatagaataaatatttccattcattagagttgttaaaaggagactgaattaatattttatataaagattttgttacattatgggaggttctatcctattctgaattggagagtatatatatatatatatatatatatatatttttaataaactttattaaggtgaaataatttcaagtttacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggtttataaggttgtttgtccaactaatgaaaatgcgcttaataaaaaattctgaccttgggtaagaattcgctttttaccgcattgccgctttcatgtacatacatgagtgcatgcacctatcaatgtgttttcttcccaacacttattaaatataaaacaacctgattttgtgctcgtttctcgtttttcttgaggccctgaagcttccaagataaatataagactaaaatttgcttgttccttcacacctgatttctcctagaaccataaatacctcctatggggaactaagaaatcatgaatactgggattttcttattggattttttacttttgttttgtggggataacgagacagaagtgaaaggaaaactggtgccggtattactgttgaaattaatgtacagtgaatgtttttaaagtattaattttaaaaaaccatgttctctagaaacaagttttaaaaatctatatgaaagttttaaaatgttccagctaactaatggataagcataccagtaaagccaaagtaaaggttagtgcctttaaaactaacctgtgttagagttacatgaatctggctctaaagtatctattttgcatccatttatatatagatcttaaacagaaatactctaggttgccacaccacagttttaagaagttatgctgctgctgttactctcttctaggattctggtggtaaagtagagaaactcggacactatattaaccttactgaaacatgctttaaatcgtgtctaaaatctgatttgagcaagtcactgccgagcttctgagtctgcattgacactgctactgactcacctctccttccctggaataaggcttcagcttccctatgctgtgaagacaccatttgtaagcactttgaacataagcactgtgtgacagcgctggatatcatgcttgggggggggcctctccctgactcccatccccataataatgagttttgtttggaattgtaataagtaatgaactgcatggtttagaaaattataaatatttgatcagctgtcctctctgaaaaaaattgcacccctttttcttttttaaaattttgttgcatcttcgtagtaatgtaattgtattttatgcctgcttttttataaaaaaataaaataaaataaatggagacataagcatttt

SEQ ID NO: 26377 - DNA, 2700 bp, Homo sapiens
aagtgtgtgtatgtgtgttatgctaagcttgccactgaaatgctttttatcatagttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggccc

SEQ ID NO: 26378 - DNA, 4017 bp, Homo sapiens
atgggccatttttgtctatcttaatctatccagctagaacttaatatccctatatatttttggtctttttgatagagtctgttatattctgcaacccttaatcaatgtttaataggtggagttttttattgtacccaaagctccctcttgtggtatttggtataatatagtgtgaaatgattaacagtgcaaattatctttaatgaaaatgaagtatgaaataatttcctaatagaatgctaaacttatgtctgctatacataagagaagatgtttttgtgttgtacttccatgaatgtattgcgattttcattaaaccaaaaacttttggcactagggtacagacaaataaatcataccacatatttttagggaagataagggtggttaaggagagcaaggtgtagagaagaagaatatggggaacgggatagaatatggtacctacagaataattgtataagcatacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctg

SEQ ID NO: 26379 - DNA, 2992 bp, Homo sapiens
gcattcccgggcgggccggaccggcgggcgggcggggactcggcgcgggccctcccggccagcggcggcagcctcctccccggcgccctcaggaccccccagagcccccggcggcggcagcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcgtccacgctggcagtgtgggtgaagtggcccatccatcccagcgccccagagcttgcgggccacaagagacagtttggctctgtctgccaccaggatcccagggtgtgtgatgagccctcctccgaagaccctcatgagtggccagaagacatcaccaagtggccgatctgcaccaaaaacagcgctgggaaccacaccaaccatccccacatggactgtgtcatcacaggacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgaggtgcctgaccagttctaccgcctgtggctatccctcttcctgcacgccgggatcttgcactgcctggtgtccatctgcttccagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataaccttctaacttgtttcttgacgaccacctcatgtggccaataaatggactgggagcgttttagctgccattaacttga

SEQ ID NO: 26380 - DNA, 1979 bp, Homo sapiens
atgctcccaccacaggctggaagcggtgggatgagagttccaactgtggcctgcagagtgggctggcgggctggtccaggacaagagaaagtggtgccaggcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagcagccgacaagtacgcttcgggcgtgtccacactctgcccctcttgggtccccgggctgcccgcagggccttcccacagcgccagtctctctcttggtccctgctcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggtgaggacggggctgggggcggggccggcgggggcgggacctggaggtgcccggcgggggcaggaggccccggactgcggccgctcgtctccctcgcccgcaggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcggtgcgtttccccgcccgggactcccgccttcgtctgcccggtgttcgctcttcagacctcagatagactcggcagagtgatccttcg

SEQ ID NO: 26381 - DNA, 901 bp, Homo sapiens
gacggccctgctgcattggcaccaagggcaggtgtgagatcacctcccgggagtactgtgacttcatgaggggctacttccatgaggaggccacgctctgctctcaggtgcactgcatggatgatgtgtgtgggctcctgccttttctcaaccccgagatgactgtcctgcgggacctggagaagctggcaggctggcaccgcatagccatcatctacctgctgagtggtgtcaccggcaacctggccagtgccatcttcctgccataccgagcagaggtgggtcctgctggctcccagttcggcatcctggcctgcctcttcgtggagctcttccagagctggcagatcctggcgcggccctggcgtgccttcttcaagctgctggctgtggtgctcttcctcttcacctttgggctgctgccgtggattgacaactttgcccacatctcagggttcatcagtggcctcttcctctccttcgccttcttgccctacatcagctttggcaagttcgacctgtaccggaaacgctgccagatcatcatctttcaggtggtcttcctgggcctcctggctggcctggtggtcctcttctacgtctatcctgtccgctgtgagtggtgtgagttcctcacctgcatccccttcactgacaagttctgtgagaagtacgaactggacgctcagctccactgagctggctgcgggctccagcggccgtgtgctccagcaggccagagccagacacgacctccctgagcctcacaggcttacaggagtcacctgctccatgtggggactggcctgtttcctgaacacagacctctttcttgtgccttgttcacttctgttgaacccctcgtactgccgggcatttattatactacttcctgtcataa

SEQ ID NO: 26382 - DNA, 615 bp, Homo sapiens
ctcatgctcccaccacaggctggaagcggtgggatgagagttccaactgtggcctgcagagtgggctggcgggctggtccaggacaagagaaagtggtgccaggcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccg

SEQ ID NO: 26383 - DNA, 1871 bp, Homo sapiens
atgctcccaccacaggctggaagcggtgggatgagagttccaactgtggcctgcagagtgggctggcgggctggtccaggacaagagaaagtggtgccaggcctgccttgctctgccaggaaccatgagtgaggcccgcagggacagcacgagcagcctgcagcgcaagaagccaccctggctaaagctggacattccctctgcggtgcccctgacggcagaagagcccagcttcctgcagcccctgaggcgacaggctttcctgaggagtgtgagtatgccagccgagacagcccacatctcttcaccccaccatgagctccggcggccggtgctgcaacgccagacgtccatcacacagaccatccgcagggggaccgccgactggtttggagtgagcaaggacagtgacagcacccagaaatggcagcgcaagagcatccgtcactgcagccagcgctacgggaagctgaagccccaggtcctccgggagctggacctgcccagccaggacaacgtgtcgctgaccagcaccgagacgccacccccactctacgtggggccatgccagctgggcatgcagaagatcatagaccccctggcccgtggccgtgccttccgtgtggcagatgacactgcggaaggcctgagtgccccacacactcccgtcacgccgggtgctgcctccctctgctccttctccagctcccgctcaggtttccaccggctcccgcggcggcgcaagcgagagtcggtggccaagatgagcttccgggcggccgcagcgctgatgaaaggccgctccgttagggatggcacctttcgccgggcacagcgtcgaagcttcactccagctagctttctggaggaggacacaactgatttccccgatgagctggacacatccttctttgcccgggaaggtatcctccatgaagagctgtccacatacccggatgaagttttcgagtccccatcggaggcagcgctaaaggactgggagaaggcaccggagcaggcggacctcaccggcggggccctggaccgcagcgagcttgagcgcagccacctgatgctgcccttggagcgaggctggcggaagcagaaggagggcgccgcagccccgcagcccaaggtgcggctccgacaggaggtggtgagcaccgcggggccgcgacggggccagcgtatcgcggtgccggtgcgcaagctcttcgcccgggagaagcggccgtatgggctgggcatggtgggacggctcaccaaccgcacctaccgcaagcgcatcgacagcttcgtcaagcgccagatcgaggacatggacgaccacaggcccttcttcacctactggcttaccttcgtgcactcgctcgtcaccatcctagccgtgtgcatctatggcatcgcgcccgtgggcttctcgcagcatgagacggtggactcggtgctgcggaaccgcggggtctacgagaacgtcaagtacgtgcagcaggagaacttctggatcgggcccagctcggtgaggacggggctgggggcggggccggcgggggcgggacctggaggtgcccggcgggggcaggaggccccggactgcggccgctcgtctccctcgcccgcaggaggccctcatccacctgggcgccaagttttcgccctgcatgcgccaggacccgcaggtgcacagcttcattcgctcggcgcgcgagcgcgagaagcactccgcctgctgcgtgcgcaacgacaggtcgggctgcgtgcagacctcggaggaggagtgctcggtgcgtttccccgcccgggactcccgccttcgtctgcccggtgttcgctcttcagacctcagatagactcggcagagtgatccttcg

SEQ ID NO: 26384 - DNA, 3603 bp, Homo sapiens
cccgaggagccaccgcccagccgctcgcaggcgccgcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagggttttcagaataggaggctaaagaaaagccagcccaggacctgggctgcacacaccaccgcctgccctccctccttcctccccaagaggaagaacccagcctacttgaagagcgtcagcctccaggagccacgcagccgatggcaggagagttcagagaagcgccctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggcagt

SEQ ID NO: 26385 - DNA, 3516 bp, Homo sapiens
cccgaggagccaccgcccagccgctcgcaggcgccgcacggagttgcgtcccggggacttggggccgcagggagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagagaagcgccctggcttccgccgccaggcctcactgtcccagagcatccgcaagggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggcagt

SEQ ID NO: 26386 - DNA, 4539 bp, Homo sapiens
gaaatctttgcattcatcaaaaaagacaagaggcctagggccgggtgtgctgggattacaggcgtgagccaccgcgcccagccgcccagagatgtttgaaccaactttaggcaagttggttcttggtctgggctgcgtgccctggcgtcagggtcctgacactgcgccaccccgcaccgcccaccgctgctctcccggtctccattccagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgagaggaagaacccagcctacttgaagagcgtcagcctccaggagccacgcagccgatggcaggagagttcagagaagcgccctggcttccgccgccaggcctcactgtcccagagcatccgcaagtgagcccccctacacccaagcccagcaccccccacccagcaacctgtggattctcggggcctggacatgattgggcctggtccctgcgtcccctctctggaaggaggaggccggcattaatgagcaatgtctccctgtggcctattatcatggtatagatggggaaatgggtatgtgctttgcggaatatcacggtgtggaggctggggggcttcgaggagctgggtggatcagtgtgggggtgcctggggccctagcctggctcctcacgctcccgtcatcccctgcttctgctcatctggtcactgggctccagccaggggcctcacaggcagatccgccccccacctccctgtaggcacgcgggcacacacgtgccatcaccccttccacacactcaggtgcacaggcgtagacaagcgtatgcccacctgtcccttgtctgcttccgcaggggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtaaggatgtggaggatgggaccccttccgcacatagggggccagccctgctgctcctattccacccacctgggatctgccagagggacacggtgcccctcctgtactgggctccacagcggagggacagctaatctgggggcttactggctggtctcttaatcccagtgagagggaacagtgatgctcttgagtcaccctgtccctccaccgcctcatttatcttcctaaccgtgcccactgcctgacagtatgctaggtatctgcaggtcgagcggtaggaaatggcctccgtgcgccgtcggcagtctgatcagttccacctgactgatctagtttgttcagtgtccgtcctctccccaccgtgtgcggcctggaacaggcttgtctgtcttgcttattgctacggacccacaccaggcacgtacacagtaggcgctcagtgtttgctgaaagaatgggcggagcaggcccagctttggtccagcagctccagccgaccccctgcccctcagcctcaggggtccccatgcctgccagggaggagctgatcgatgggatgacccagggtgcaggcccggcccaggccacccacctgatgcctgaagccacgtctcccctgccccgccccaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggc

SEQ ID NO: 26387 - DNA, 1614 bp, Homo sapiens
tagcacttcatagactgctatcacgcattcatttttactagtacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaatgtgcagaattaagatgtgaaattgttggaacaaaacaccttcattaccagattagtattcttcccacatggacactgagtaaaagtggctgacaaagcatggatagaaaatgcatcttcaatcaaagccagactgtcagattttaaaaggtagtatgttaaccagacacagtgttgttgttctgtgattgttaggcataatttagatgagtgtcttttatatggtcaattgaagtttttaccagtttatttctccatttgttggtactgtgctagtcattcattcatcctctcactcatcaatatttattgaggttagctatgtgccaggaatagggttgcaagaaataaatacaggacacccagttaaatttgaatttcagacaaacaacaaatatgttttgttttggtttttgctaaacctggcagcattccaggaactatgctggcttctgagcacatacaaataaataatatcagaattctgccttcaa

SEQ ID NO: 26388 - DNA, 1007 bp, Homo sapiens
gccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatcaattttcttgtacaactggtacacactaataaacaattaaacatatgagatcagaaa

SEQ ID NO: 26389 - DNA, 727 bp, Homo sapiens
aggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccaggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggaga

SEQ ID NO: 26390 - DNA, 683 bp, Homo sapiens
gaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtatttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctct

SEQ ID NO: 26391 - DNA, 704 bp, Homo sapiens
cccgccgaggttctactgctctccttcttaagaagggtgggaggcactcggtctctccccacacctctcgcctgaggccaggcgccaggtgtcgcctgaagccagacagccggtttgggagcgagcctgagggcaaggggaaggcaaggggatcttcaagagaatgtgactgtgggggattatggctttctggccaatttgttacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatct

SEQ ID NO: 26392 - DNA, 548 bp, Homo sapiens
gctacccctggtgacctggcagcggagcccgcgcagggtttgccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgagcaatttatctcaaagctgcaagttcctgccatctacatgtgcccaggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctca

SEQ ID NO: 26393 - DNA, 1066 bp, Homo sapiens
ctcgcgtcccgggtgcctggataccgagcgcgtccgtagtggcggctggcgctagggaactgcagggtctagggtgttgtcggagtggcagttggtccgaatttctcccgaagcccgcggaggagcgggtaagagccccgcgaatccggccccaacctcgggaacgggatgggaggcggccctggccgcaagccccgcgctgctagcgggtccaccgcgtcgtagccgacagccgcccttcttcctcgcagcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatcacaca

SEQ ID NO: 26394 - DNA, 1291 bp, Homo sapiens
gcggccccaggcgcaggcgggtcccgcagcggggcccgtgccgcccaggcgatcagccccttcacttaacccgcttccctcctagcaggcccgagtcccctagcctcagcctcacgcagccagagcaaggggaagagggagtccttcgtgagttcgccgctcacattcggcggtgggaaaccgatccgaagatgcttttgtaggcgaaacgctcagctcgcgcggctctgaaccaccggggagcagcggctgctgctagtcggactacgccagcacctccttgtccagcccgggagcagccccgcctcgctcagggccgcgtgcgcgtgcgcggctccaggggcggggcctgctcgcgtcccgggtgcctggataccgagcgcgtccgtagtggcggctggcgctagggaactgcagggtctagggtgttgtcggagtggcagttggtccgaatttctcccgaagcccgcggaggagcggcgcgccgcgattcaccagcctggtcccttctgcggagagcgatgccgcttcccgacaccatgttctgcgctcagcagatccacattcccccggagctgccggacatcctgaagcaattcaccaaggctgccatccgcacccagccggccgacgtgctgcggtggtccgcgggctatttttcagctctgtcgagaggagatccacttcctgtaaaggacagaatggaaatgcccacggcaacccagaaaacagacacaggcctgactcaaggactcctgaaagttttgcacaagcagtgtcaccacaagcggtatgtggaattaacagatcttgagcagaagtggaagaacttgtgcctgccgaaggaaaaattcaaagcgctcttacaactggatccttgtgaaaacaaaatcaagtggataaactttttagcgcttggatgcagcatgcttggtgggtccttgaacactgcgctgaagcacctgtgcgagatcctcacggacgatccggagggcgggcccgctcgcatccccttcaagacgttttcctacgtttaccgctacttggccagattagactcagatgtgtctcccttggagacggaatcctaccttgcctctctaaaggaaaatatagacgccaggaagaacggcatgataggtctttcagatttcttctttccaaagaggaaacttttagaaagcattgaaaactctgaagatgtaggccattaatacagagaagaatacattttaatgtcaaaatagtgctctttaaaattctggcaccaaatacaacttaccctgaatca

SEQ ID NO: 26395 - DNA, 4473 bp, Homo sapiens
ggggtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 26396 - DNA, 4339 bp, Homo sapiens
ggcgggacccagagccgccgcgggagcttccagcgtccccaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 26397 - DNA, 2110 bp, Homo sapiens
ggcgggacccagagccgccgcgggagcttccagcgtccccaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccagacgtctttgattgctctggaaagccttggtgtccttactgtggtgttcactctcttcttacagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtaaaccaagactagtacagcgtggttgagcttgaatgcaatttccttttcaaaaccagcagcgggtttacaaatcaacaaaaaccacatcatatggccttgaaatgtgctgggttctgcactgtgtctaagaaaaggaaaagaaaaaaaaatggtattgtttcctgatgtcaagaaaagaagcgtgccctgccaatgaggaagtactgtgttgaaaacaaccagtggtcaagctggaaggtttgctagattaggattctgtaacaccctccaactgcgggctgctttgattgctggttctctgagtaacacttcacttgccttctgttagaatgttttaagttattttggcacttggtcaccctacttcagaaagactgtttggtcttttcatgaccatattggcagagtctaatgttatttgctttggattttgtgttatctgaaaagtctattatttttattagaaggtcatttttaaaaagaaagaaaaatatctccaaagtccttcgcaagacatatttccaaaatgaacagaaacactaacgtttatttttttaaaaaggagaaaaaaatctagtaatgggaaaactcctctagaaggacattaatatgggtaggaacatggtcaaagtgccttaaaatatttagcaacctctccttgccaccataacttaacgtctctctcaatgaatgggttatagctgttaaattctgtattaatggagactttttttttaccacttaattataaatgaacacatttcattttcagtgtagaacgtagatatcatggccttgttgtctcttcttaacatcaaacatcatatcaccttacaggattttattagttaggtactccaagcacgtgaattactccttggtattgagataagcatttctgaagattcttctatttctacaagccagtagctctttgaacggacttttattgtcatttatctaagtggcctaaaataatgaataaactgctgaaagagtttgccctattcccaggaattatttcacacactgaaagaatctgtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgctgggcagtcaggtttgtaacacctatggttttgaggaagcttgatttgatgactttaggcagtgtaaggataaatacagtagatttcaaaggacttttttatatccccacttctaaaacagtgtcatgaaaatgatgagcctgatgatgagttaatggaaatatttgggtttagaatctagagactatttcaacagctcagtggtttgttgccactagaaatttatgcatttgtcaatacctgtg

SEQ ID NO: 26398 - DNA, 5451 bp, Homo sapiens
atttttttctcctcctttttttaccctcccgtttttttcttttcttttttttttccctatcctttttttgtgaatgaaaaaaggaggtcgcgagcggtacctgggactgcagcgccaggcgtcttcgcggcagcgccttcgccgcgggcccgggcgcgtagcggcggcggcctcgcccctctcccggcgcccctgcgcgccgcccgctgcctccgcagcccggctccgcgcgccgccgtgacattgggcgcctggcgcgcggggcgatgctgatccggaaggggcagcggctgcagtgcagcgcgcgcgtccgctcctgggcccacgtccggcctgggctgccctgccggagtttctgagtggccgcgagctggccgggaggctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcttcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctagcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagtgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacacaa

SEQ ID NO: 26399 - DNA, 3505 bp, Homo sapiens
gtccttcacctgccttcccataagctggactttggatcccagcccttaaaacccttgtgttgtttcttcctgcagacctggtcgagaacactacttcaggacagggaatagtgacaggccagcagagccccagaggcgaggtggcagtaaacaagaatatgcacgcgcagtggaccacttctgaaggtcaacatataactttctcatccctgacatcaactgtcatccctgtgagcagaaccaactaccaaaggagagaggagcctggagggaacacagagcgatgcaagcctggagaaaaggccccgatggcccccagaagacctcttcagacagcatgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcttcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctagcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaag

SEQ ID NO: 26400 - DNA, 4959 bp, Homo sapiens
agaggctgtagtgttccaggagaggggtgccatgaaagcgcggtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcttcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctagcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagcaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagtgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttg

SEQ ID NO: 26401 - DNA, 5537 bp, Homo sapiens
ccgccaccggagctcccggggcctccgcggggagcgcgtcccccgcatccgcccgacccccggggctggcacgtgctgcgcccggtccgctgagggggcggaggccccgatctccccgaccccccttctctgcttagaggaggaggagcagcggcagcggcagcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaagtttaa

SEQ ID NO: 26402 - DNA, 653 bp, Homo sapiens
cgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaataaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaa

SEQ ID NO: 26403 - DNA, 2142 bp, Homo sapiens
cgagagacagaagccgaggagaggaggctaagccgggcggcgcggggagcgcactgagcaggcaaagtcgcagggccgccagcatgttctcccgaaaccaccggagccgggtcaccgtggccaggggctccgccctggagatggagttcaaacgcggccgcttccgactcagcctcttcagcgacctgcccgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttca

SEQ ID NO: 26404 - DNA, 2646 bp, Homo sapiens
gggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggacagggtgcctctctctgcctggtct

SEQ ID NO: 26405 - DNA, 2220 bp, Homo sapiens
ggaggggcctgtgagctggggccgcccctgggattagcccggccttcggggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggccttctgacagtggcccgcccgctgagcgctccccctgccgcggccgggtctgcatctctgacctccggattccactcatgtggaaggacacagaatatttcaagaacaaaggtgacttgcaccgctgggctgtgttcctgctgctgcagctgggggaacacatccaggacacagagatgatcctagtggacaggaccctcacagacatctcctttcagagcaatgtgctcttcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttggtggtcctcgttaccacctcttggctcacaccacactcaccctggcagcagtgcaagatggattccgcacacatgacctcacccttgccagtcatgaggagaaccctgcctggctgcccctttatggtagcgtgtgttgccgtctggcagctcagcctctctgcatgactcagcccactgcaagtggtaccctcagggtgcagcaagctggggagatgcagaactgggcacaagtgcatggagttctgaaaggcacaaacctcttctgttaccggcaacctgaggatgcagacactggggaagagccgctgcttactattgctgtcaacaaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagccaatggaagcagtgctgtgatgaaatcatgaaaattgaaactcctgctccccggaaaccaccccaagcactggcaaagcaggggtccttgtaccatgagatggctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagca

SEQ ID NO: 26406 - DNA, 2684 bp, Homo sapiens
aagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccattccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtgatattttttctt

SEQ ID NO: 26407 - DNA, 1973 bp, Homo sapiens
caggcaacaaggaactaatactcggggtttacaggaaccaggggatgggccagatatggagaaagagacgcctctggccttgggggctcgttcttgagggaatcagcgtgatggggatgagaagggcatctttggaacgggggccttctccataggaagaggaggcgagtcccctggccatatttaaaccacagttctccacgccacctgtgcgactcgggatccaacctccccgcaccagccccagtccaggtacctggaacttagtccgatcggtaaccggcgactacgtggggtacaggtacccgagcgcgcccccgacagacgcaccgacctgcgcgcgcgccgcgggcaggatgcgtgcgcactccccggacgtcccgccccgccccctctgcggccccgaagctgggcggcgtgcgcgcccccgcgccgcgccgagccgggcgctcggaaaggcgtccccgcggtgcctgacagttccttcctcagcgcctgccccgtgagtgacgaggagcgcggagtctcgccatatcaggagggccctgttacgtgaggctgtgcaccgagactattccaggaagaagaggggacacttggtgggcggggtgatttcgggcagtcaggtgggcgacccgcgtaggcgtctgaaaggcccgcgtcgttagggagggcaggagtggcgtctctggttacggggtcgggcaaagggcagaggtcaccgtccaggttggacagcagcacctttgagcgatggcggcgtctggggaaccccagaggcagtggcaagaggaggtggcggcggtggtagtggtgggctcctgcatgaccgacctggtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacataaagacaagtaacctcaa

SEQ ID NO: 26408 - DNA, 1547 bp, Homo sapiens
gagcgatggcggcgtctggggaaccccagaggcagtggcaagaggaggtggcggcggtggtagtggtgggctcctgcatgaccgacctggtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagatgaacatttagcagaaaatattttagcgagtcttttgtaagatactaagtcctattggattaactgttttctgtctagaatagtggggtcacaaaaaaaaggggattgctgaccacaaaaggcaaaaggccaacctttagaactcagtgaatcactaacagacattttagttttaattgcgatttactcaccaatatatatacaaagctctcattaatattgcctgaagaatgggccctttttaattccatttttagctcgctctcaggattccacttctctttcattaacatggaattctttaaattatagaataaattaacccaccgcaaacattttgggcagaatggggttttcagcaattttcagcctccacaggccattcttctcagcagcttgccagcca

SEQ ID NO: 26409 - DNA, 1887 bp, Homo sapiens
ggggagagaaggggcccaacatggtccatctcgaccttcctctgccgggcccagggcttcagccccgctcccataggccccgccccatcccagacctcgcccgccttcgggatctcagccctggctccgcttcttcaagtaccgacaggaagttgacgagttcgggctcgtcaggggccgagctccgggctccgccctacgacaccgcccctccctaggccccggccctcatcaggactccgcccagacgtgcgtcatcttcccgcgccggtgacggaagtgcggtgttgagcgccggcggctcgcgcccacgctgggccgggagtcgaaatgcttcccggtgccgggagtgagcgatgagctggcttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattggagaattatgtgagatttccacattatgtttactgggttcaatactgtccttgcttgttttattgcaggcaagcaaggcaaatggcctaaaatgctgtggcttatattttgataagaaatcaaaaaaccattggttaaaagatgcaactcagaagtctggaagtattctgaaagcatccatttaccgtccagttgacaggtttgagtctcctgcttgtataggtgacttgtgcccatgggtacattaaaggaacatgctgcccagggcctgggcggacagctcagtgggcaggatgtgtgctgggtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaa

SEQ ID NO: 26410 - DNA, 1142 bp, Homo sapiens
gcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggccccatggtctacgccatctgttattgtcccctgcctcgcctggcagatctggaggcgctgaaagtggcagactcaaagaccctattggagagcgagcgggaaaggctgtttgcgaaaatggaggacacggactttgtcggctgggcgctggatgtgctgtctccaaacctcatctctaccagcatgcttgggcgggtcaaatacaacctgaactccctgtcacatgatacagccactgggcttatacagtatgcattggaccagggcgtgaacgtcacccaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtggcccgggaccaggccgtgaagaaatggcagttcgtggagaaactgcaggacttggatactgattatggctcaggctaccccaatgatcccaagacaaaagcgtggttgaaggagcacgtggagcctgtgttcggcttcccccagtttgtccggttcagctggcgcacggcccagaccatcctggagaaagaggcggaagatgttatatgggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgattaattttattt

SEQ ID NO: 26411 - DNA, 1594 bp, Homo sapiens
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatca

SEQ ID NO: 26412 - DNA, 1587 bp, Homo sapiens
actcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatggcagcacaaagacagaaaaggggcaagtgatggtggtggctccacgcaaggcttggcggttttccctgcaacttcagacactcccagaggactcggactttttcttctgcacttttttggaaaatcgccaggtgccaaaaggtgcattttaaagcgctgactgtaaatgctttatttctttgattagtaccactagtctatgtgggcagcggcattcctccctggagcactcagctaggcggttccgtccaggagcttgaaagcatcccagcggtgcacctgttcagtctgaggacctcaagcttgggtcaggccagcatgttttaggtatggatgtggtgacttaaagtacttgattgtcttgatttcaccctgaaagctttggcaaaccaagtttcaacccttactttaaaaatctgacactgctttactccatatcaatttggaagcttctaattcataaatatacctaaacgttggcattttatctctccaggagttattaaacatttcttccttttt

SEQ ID NO: 26413 - DNA, 1587 bp, Homo sapiens
ccgctggctagaccatggagggccgctgggtgcagccacagagcgcggggccccggcgaccccgccccgctccgcgtcactcggcgccctgcggcgcgcgatgagcacctaccactagcggagccgcgagggagaggccgcggccccttcccgttgcctgcggccaccggccggcattcagagcccctcgcctggcgctaaatttaaaaacgtaacacgagcagcaggctggtctcggaaacgaaacgaaattcggtccctgggcctcctcccgggcgctgccggtccctcagcgcgccgcgccacccggaacagacccttctcccgccattttcggcggggctgggagactgaggcccgcggcgctgagcctgcggcgccccggaagaggcgggcggcatggccgctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaaaaaattggaaaggtttgaaactttgaaaataaaatctagcaaaaatatttgctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatca

SEQ ID NO: 26414 - DNA, 2794 bp, Homo sapiens
aaaacacaactggaaaaccctaggacttgaacccagggaaagcgttagggggtaaggggactacacttcccgtgaagctccgcggcggcttcccgtgaggccccgcggaggcttcctgagaggtcctgcgcgctttccgcgccagcttcagtgtcagctcgcgagccctggcgtcgcgtaggagggaggatggagagcggcgacgaagcggccatcgagaggcaccgcgtccacttgcgctccgccacattgcgcgacgccgtacccgccacactgcatctgctgccctgcgaggttgcggtggacgggcccgccccggtggggcgcttcttcacgcccgccatccgccagggccccgagggactcgaagtgtcgtttcggggccgctgtctacggggagaggaggtggcggtgccgcctggcctcgtgggatacgtgatggtgacagaagagaagaaggtgtcgatggggaagccagaccccttgcgggattccgggactgacgaccaagaggaggagccgctggagcgggacttcgaccgcttcattggagccactgccaacttcagccgcttcaccctgtggggtctggagaccatccctggcccggatgccaaagtgcgtggggccttaacttggcccagccttgcggcagcgattcacgcacaggtgcccgaggactgagaaccagagcttgaaattcaaagctgcgatcccttcacagcagtaaaccagctctttggaaccgattccatcaccccaataaaggagctcttcacagcacctgtgagtctgggcgccttagagcccctaagccagcatgggccctttccccctccccaccaagaactttgcatggctctggcatatagaaacaatttattgccgggggcaataggggtaagagaagccagaaatttttgcagccagcacccaccccacccccaacttctactttacaaaagaaatttttacaatcaccagccctctgtacagagctcccccatccggatcccttctcactgtacacagctgcctggctccctctggtccctgcttcagaggaggcctgggcctgtggccagctgaccttggagttggtctgagcccggagctcgccttggtgctgggcaccagtgggcccctgccaggcctgtcctctcctttttgagctgtcctcagccccatctcccttagagtgctttgtgggagctgcagtgggggcggggtgggctatcagccccagtcctgctgccgtcttggcactgcagtgggcagtgtctggtcaccacttccccctcttgctccagtccttgggagtgaagtgcagacacttggagtcgatccgcaggagccgcttgagcatggcccgctcatggccatccacgatgtcctctgacagtgtgaggatgtactggccctgggcagaggagatgggttcagcaggtggtcagcccacagaggactgcactctgcatcccacacacctgtctcccctgcctgcctccctaccttgtagtagttgatgagattgaggtactgcagagtggagatgacatcctccttcttgatgctggtgatttcactaatctcactgtgggagagcacaggtcaggttccctgaggacctttatctgtccccaggagccctgagagagaaagcccaggaacagacaagccatgccatgtacccccaggtagacagcgccaggctcacttgatggtgatctgtggcctctccccgctctccgacttcagccccatcaggatctccaggatggtctgggaccagtagcttcgataggataggaggccaaggtctgagaggggcttctcaggggtccctgttttcccttccactttggagagttcatagcctaaagcaatggagcaggagagggtgagtaagaggtcacagatgaacataagcaacatttaaaaacacaggttgccaaggcaggctgcctagttcctatcatggccctgccacttggcagttctatgccctccacttctctgtgcctcagttccctcaggaagaactgagtattcactctttccgtgcgctgagcacagtggagggcatgagggcactgagaggagcagctgcagtcaaccatgagggtgatcagaggccagtgaaggcttatgggcaggggatgcagagaaaatggctcatgggaagaaggggcctccaattttcctttgccatcccgggctctgtgtctagccatgtaaggaagtggagacagattcctgtctctaatccagacctgagaatgcttgaattctcaaagtcctcctagctgggaccttgggagtgtcacctgctgtaagacttgagtggcctgactgggtggttgtgaggatgcaaggagaaaaggtgcaccaaggtgcttcctaagtcggggagaccattcctgggagccacgtgactgacccccaccatggctctttccctccaactcgtgctgatagctggccgctgggaggccgtccccagtgagatcctcagaccctgcacagccctgagtggcttcacatctcttggtcagtgtcttcattctccccagtcagggacctgggatgtttgttacttctagaagcccttcctcaccctcataatggaccttagccccttgctggtcccactcacatcccgtctccattgctgtctgagttccaagactgagtttcttcaagcatccacttgtgctaccaggctgagaagttctgaggatgtgaccccatctgggcatcatttaaccaataaaatttctcgaatggaccataa

SEQ ID NO: 26415 - DNA, 4238 bp, Homo sapiens
gacgcagcaggaggaaactgctcgggctgcaagcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccctattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggacatgtcaattaaaatgcccatttgtgaagcttactcaataaaactttaaattgtctta

SEQ ID NO: 26416 - DNA, 4148 bp, Homo sapiens
caggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccctattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggacatgtcaattaaaatgcccatttgtgaagcttactcaataaaactttaaattgtc

SEQ ID NO: 26417 - DNA, 4046 bp, Homo sapiens
gacgcagcaggaggaaactgctcgggctgcaagcagtcttccaggctttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagatgagcaagctgaggcacagacaaataatttttccaactacacagaaccagtaaggggtgcaccaggatttgaagctgggaaggatggctgcagaggccatgtgcttaagccacaccactacatgaagctgtgatggcatcaagtctaccaactcatttactcactgaggaaattgaggctcagagaccacactcaaattactcatgctggacagtcagagattggcagacctggaaagaggaacttgttcttttatttcccaatttattggttcttttccctaaattccatgggcttatattgaattttgatagtcttcaggttttaacttcaagttttaccttttaattcccattttacactttgtttttctgttgacttgcccattttcatggtcacacaattaattttgtcagcataggtctggagcccaagttttccagcttgtatgactgtattggttcttgacttgccccatcctgccacacatacgtgcttggcgtttctcacgggtgttctgcacagagtgcacctggccagtctcagcagcatcctcactagcattgctctttcatcagttactcttcctaagtgacccactggattcttgactgttgcatcttgatctcgtagcccaaactctttctaaatatgagagccatctatggctctgtatctatgagggtgacaagcacagacaaagaggatgacattactgtgatatgaaaggagttgccctgggacacctgcaggcaaggagaagcaagtaaccttgtttaaaatataaattttagagggtactagtatagttttgttacatggatatattgtgtagtggtaaagttgggcttttagtgtaaccattacctgaataacgcacattgtacccattaagtaatttctcatccctctccctccaaccctcccacctttccaagtctccaattatattattccactctgtacatccatgtgtacacattattgagctcccacttataagagagaacatgtgatatttgactttctgtttgtaagtcatttcacttaaaataatggcctccagttccgtccatgtggccacaaaagacatgatttcattcttcttttttatggctgaaatggcccagacacattttctttatccaatcatctgttgatggacacttaggtggattccatatctttgctattgtgaatagtgctgtagtaaacatatgagtgccggtatctttttgatataagatttcttgggctgagtgcagtggctcacacctgtaatcccagcactttgggaggccgagatgggtggatcatttgaggtcaggagtttaagaccagcctggccaacatggcaaaaccctgtctctactaaaaatacaaaacttagccaagcattgtggcacacgtctgtaatcccagctacttgggcggctgaggcatgagaattgcttcagcctgtgaagcagaggttacagctttattttggcagatactcagtacattcttttctctgcatcctcatcaacatctgttactttttgactttttaatagtagcccctagtataagatgatatctcattggttttaatttgcatttctctgatgattagtgatgttaagcattttttcatatgctttttggcaatttgtacgtcttcttttgagaaatgtctattcttgtcatttgcccactttttaatggtgttattattttttattgttaagttgtttgagttccttgtaaattctggatatcaatcctctgttggatgcatagtttgcaaatattttttttcccatgctgcaggttgtttgttcactctgtttatttcttttgctgcgcagaagtttttagtttaattaaaccccatctgtttcttt

SEQ ID NO: 26418 - DNA, 2348 bp, Homo sapiens
tttgcggctgccaaaggaataattgagacgtctgagttgagcaggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaataggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctga

SEQ ID NO: 26419 - DNA, 525 bp, Homo sapiens
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26420 - DNA, 579 bp, Homo sapiens
gcgaggggtggggcgctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 26421 - DNA, 594 bp, Homo sapiens
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26422 - DNA, 577 bp, Homo sapiens
gcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26423 - DNA, 594 bp, Homo sapiens
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 26424 - DNA, 525 bp, Homo sapiens
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26425 - DNA, 522 bp, Homo sapiens
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26426 - DNA, 525 bp, Homo sapiens; identical to SEQ ID NO: 26424

SEQ ID NO: 26427 - DNA, 525 bp, Homo sapiens
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 26428 - DNA, 594 bp, Homo sapiens
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26429 - DNA, 522 bp, Homo sapiens
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccaccgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26430 - DNA, 525 bp, Homo sapiens
gagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26431 - DNA, 577 bp, Homo sapiens
gcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26432 - DNA, 522 bp, Homo sapiens; identical to SEQ ID NO: 26429

SEQ ID NO: 26433 - DNA, 594 bp, Homo sapiens; identical to SEQ ID NO: 26421

SEQ ID NO: 26434 - DNA, 577 bp, Homo sapiens; identical to SEQ ID NO: 26422

SEQ ID NO: 26435 - DNA, 594 bp, Homo sapiens
gagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26436 - DNA, 577 bp, Homo sapiens
gcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgaccactatcctcctccgcccccagggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26437 - DNA, 525 bp, Homo sapiens; identical to SEQ ID NO: 26424

SEQ ID NO: 26438 - DNA, 522 bp, Homo sapiens
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagacgaagggttccagtaaccagtgatggattcacctcatctcccaaataaagtttacttgttttacattcca

SEQ ID NO: 26439 - DNA, 522 bp, Homo sapiens
gtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaagcggctcgtcttgcggcgggatccctcggtgaagaggactctctgtcgaggctgctcttccctcctcgtcccgggcctcacctgcacccagcgccagagacgctgcaggggacagcgctggaccgtacagacctgcctaacatgccagcgcagccaacgcttcctcaatgatcccgggcatttactctggggagacaggcctgaggcccagctcgggagccaagcaggtgagagattccaaaccactacaacccttgccaaacacagcccactccatttcagaccgccttcctgaggagaaaatgcagactcagggttccagtaaccagtgatggattcaccccatctcccaaataaagtttacttgttttacattcca

SEQ ID NO: 26440 - DNA, 522 bp, Homo sapiens; identical to SEQ ID NO: 26439

SEQ ID NO: 26441 - DNA, 594 bp, Homo sapiens; identical to SEQ ID NO: 26428

SEQ ID NO: 26442 - DNA, 522 bp, Homo sapiens; identical to SEQ ID NO: 26429

SEQ ID NO: 26443 - DNA, 525 bp, Homo sapiens; identical to SEQ ID NO: 26430

SEQ ID NO: 26444 - DNA, 594 bp, Homo sapiens; identical to SEQ ID NO: 26428

SEQ ID NO: 26445 - DNA, 577 bp, Homo sapiens; identical to SEQ ID NO: 26436

SEQ ID NO: 26446 - DNA, 577 bp, Homo sapiens; identical to SEQ ID NO: 26422

SEQ ID NO: 26447 - DNA, 767 bp, Homo sapiens
cagcatggcggtgtttgcagatttggacctgcgagcgggttctgacctgaaggctctgcgcggacttgtggagacagccgctcaccgtgagttgccccggcttcgcgcctggccaacctcatgccacccagaccatcgggccacactccggattggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggag

SEQ ID NO: 26448 - DNA, 2589 bp, Homo sapiens
ggagtattgaatagttgggaattggaacccctccagggggaaccaaacattgtcgttcagaagaagacaaagagagattgaaatgaagctgttgatttcaacacacaaattctggtggtagatgaaagcaaagcaagtaagtttctccgaatccctagtcaactggaggtagagacggactgcgcaggttaactacagctcccagcatgcctgaggggcgggctcagcggctgcgcagactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggatcatgttaagtagaagtagctttttatgcaaatacatgcatttatgcaatattaatgtaagggctctaaaacaatggagtagagccagaggtataactgaataagaaatttttttaagcaagagaaagacaactgttctgcgggttggagaaaatacaatttttttttttttttttgagacagtctcgctctgtcccccaggctggagtgcagtggctcgatctctgctcactgcaagctccgcctcctgggttcatgccattctcctgcctcagcctcctgagtagctgggactacaggcgctcgccatgtatttagcagagacggggtttcaccgtgttagccaggatggtctcaatctcctgacctcatattccacccgcctcggcctcccaaagtgctgggattacaggcgttagccactgcgcccggcccgagaaaatacagttttaaaaagagaaagctttataacctcaccaatgaatacaaatgtttaaataaaatattgattaaaaaaacattaaaagt

SEQ ID NO: 26449 - DNA, 1721 bp, Homo sapiens
acttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaacc

SEQ ID NO: 26450 - DNA, 4272 bp, Homo sapiens
agactggcgcgcgcggacggtcatgggacttcagcatggcggtgtttgcagatttggacctgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagaatgtaattatatctagtgctgcagaaaggcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtggtctcactctgtcacccaggctggagtgcagtggcacaatctcggctcactgcaacctttgcctcttgggctcaagccatcctcccacctcagcctcccaagaactagaattcaacaaagacaacttttgatctctcatcagagagatcatactcccaagaacaggctttgacccttctttaaaagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccaggattattggtgatgtgttgcttcctttgttactcatttctgtattggcataatgagtattgggtgttcaagaggagggggaaggaagtatgacagatgttatggggaaaaagcaaagtacaacaggaagacaccttgggggaactaatagaatctaaggactcaaggatggcttcctggaggaaatacagctagaacaaaggggaggaatgagaagtgatgtgatggcgtggagtgggctgtagtgggaagaagagtcttccagggagctggcacagtatgtgaaaacagtaaagcaagtgcctggattttttaaggaactgaaaatttagttgagttgaaatttagagtttggctaggaaggttatgagagataagaataaagagttaacagcagccagattttaaggattttataagacatttttaggagtttttatttcatcctgagagaaatgtgaagccatcgaagggttgaaagaggagagtgagttgatcagcattgcattttagaaaaatccctctatctgcaacttgaaaaacattctggaggtaagcaagcctggaggccaggagcctaggagggctatttgatccagatgagaagtaatggtgacctgaactagggcagaggcacctaggattggaaaacatggacagatcacagcactacttatgtagtatacttggtaagacctggttgtttaaaagagaaggatgagggaaagaaggtcaaaaacaacttctaggactctccattggccagtgtggtgtgcccttcactgaagagcaaacacaaaatgaaagattgtgggcaaagagttgagtcagtgagaaggcaaggagagaaccttataaaaaaattgactatgtgattaaaaacttaaaaatttcccccaacgtgtttatcttttccattagcagaaataactaagagttgtcttaattctaatgggatttattccatattgtctctcatgccctctacctagttattagtgcaaatatttatatgtggcaacataaaactttttaactctttattctcttctctcgtgtaccctcccagctctttaggggaggtggatttgaggcagataccataaagaaaagttggtcacatggtggtaacacgttgaagttatgccacatgagacatcagcactggcaagagaaatgtctgtgttgtagatgtttcacttggaagaaattgaaggaccctgagccttaaaagtctgacaaacttaagccaggacccctgtggggaaggtagaggggccaacaaacaagattgggagtcagagagataacaatgaaatccccaatgcctgtgggaggtggactccctggattagtactagacagaaaaggtacaaaaatatttcaaaccattctcacaactctatatgtgtctatgaccagataactggaagaccttctggttatggactatgcgtatacactctcccagatagttagaggcatatctaagaggttaacatatatgatcttatccaaaatgggtctcttggtgctagtgttttacatcagacttcactggctttcatgtatttccacaagtgccaaacatttctcatatccttgctgtattccatagagcagtgttcctgctacctggaacacttgattcttgaataactcctgtttacctttcagacaaaccctaaaggttaccacctcaaagaagtctttatagaagcctcatcatcttagacactctgtattgtttccttcatcgtatttacaacagacagatactgtgcacttactgcctcacttaacgacagggatacgttctgaaaggtgcatcattaggcggttttgttgtgtgaacatcacagagtgttacttacacaaacctaaatgatacagcctactaaacacctaggctatatgagcaatacagcctattgctcttaggcttcaaacttgtacgacatgtcactgtactgaatactgtaggcaactataacacagtggtaagtatattgtgtatctaaacaaacatagaaaaggtaatgcactgtactatgatgttacaacagctaggatgttgctatcaatagaaatttttcagcttcattttatttttatgggaccacctttgtatatgtggttcattgttggccgaaacaccattctgtggcacatgactatgtatttattcctcattattcctttaatattcatctcttccaggagggcatgtcatggacaatctctttttcttaccacaggtcttaggacctggcctagcacctggccaagaactactggcatacctccttttattgtgcttcaatttattgtgctttgcaaatactgaattttttacaagttgaagatttgtggcacctctgtaaccagcaagtctattggtgccattttttcaacatcatgtgcctgtttcctgtctcgctcatgtcacattttggtaattttcacaatattaaaaactttttcattattatt

SEQ ID NO: 26451 - DNA, 726 bp, Homo sapiens
gaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgcacacatttagatgtggatttagtctgcataactgtaacagagaaactaccattttacttcaaaagacctcctattaatgtggcgattgaccgaggcctggcttttgaacttgtctatagccctgctatcaaagactccacaatgagaaggtatacaatttccagtgccctcaatttgatgcaaatctgcaaaggaaagcctttagaaataagagggccatatgacgtggcaaatctaggcttgctgtttgggctctctgaaagtgacgccaaggctgcggtgtccaccaactgccgagcagcgcttctccatggagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgattta

SEQ ID NO: 26452 - DNA, 1457 bp, Homo sapiens
accacggattcgccatcgtgagttccaggtgggcgcgcggggcccacgtagggcaggaggccagccccggggggatcgggcccgggactctgcggaatctggaggccgaagcccgcgcgcacgcagggtctctgctgcttccccaacgcctgttgcgtggccgcaggacccgccgccctcccggttgggccgcccagtcccgggccgggcgcgtgcacccagagcttccgcgtttctagtccggctcctctgctggattgcagcgccggctgggcaccaggagtacaaagcgaaaacccccgccggcccttctgttctccacggtctccaaggagacacggacaacagaacaacacttccgtgtgctaaatagtaaagcaccaagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacataga

SEQ ID NO: 26453 - DNA, 834 bp, Homo sapiens
ggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggttctcactctgttgcccaggctggagtgcagtggtgtgatcccggctcactgcaaccccgcctcctgggttcaagcgattctcctgcctcagcctcctgaatagctggga

SEQ ID NO: 26454 - DNA, 1030 bp, Homo sapiens
gcgcacgcgcggcgcaggcgcactgggcgccggtgctgttgccttcaggtgaccacggattcgccatcgtgagttccaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatacttacata

SEQ ID NO: 26455 - DNA, 1296 bp, Homo sapiens
ctcgttgtgtcgtttccgggtcgcgcgacgctgtgggccgctttcccctctccggagtgacctaacacaggataacgaaacctgcactgctccgagcgcttcctccccggcccgtcgcgtctgcgaggcgaggccgggaggcgagggctctgcgcacgcgcggcgcaggcgcactgggcgccggtgctgttgccttcaggtgaccacggattcgccatcgtgagttccagacagggtcagatgtgttactgggctggagtgtggtggcacaatcacgctcactgcatccttgacctcctgggctcaagtgatcttcccacctcagcctcccaagtagctgggactacaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgcccccgtcattggcttaaaatgtgttctagccttggcgttcaaaaagaacaccactgactttgtggacgaagtaagagccatcatccccagagtccccagtttaagtgtaccatggcttcaagacagaattgaagattctggggaaaatttagagactgaacctctggaaagccaagacagagagcttttggacacttcatttgaagatctgtcaaaacctaagagaaagcttgctgacggtcggcaggcttctgtaacattacaaccccttaaaataaagaaactgattccaaaccctaataagataaggaaaccacccaaaagtaaaaaagctactccaaagtaatcttgcataaacttgtcatgtcatacagtttgtgaaaggacaccttgtaaagaagccttgaaactaataaaatgagttatactta

SEQ ID NO: 26456 - DNA, 863 bp, Homo sapiens
ggggcccacgtagggcaggaggccagccccggggggatcgggcccgggactctgcggaatctggaggccgaagcccgcgcgcacgcagggtctctgctgcttccccaacgcctgttgcgtggccgcaggacccgccgccctcccggttgggccgcccagtcccgggccgggcgcgtgcacccagagcttccgcgtttctagtccggctcctctgctggattgcagcgccggctgggcaccaggagtacaaagcgaaaacccccgccggcccttctgttctccacggtctccaaggagacacggacaacagaacaacacttccgtgtgctaaatagtaaagcaccaaggattttcaaaatggctgcagctcctcaagcaccggggcggggatctctccgtaagacgagacctctggttgtgaagacgtcgttgaacaacccatacatcatccgctggagcgctctggagagcgaggatatgcacttcatcctacagacgcttgaggacaggcttaaagctattggacttcagaagattgaagataagaagaaaaagaacaaaacaccttttctgaaaaaagaaagcagagagaaatgcagcattgctgttgatattagtgagaatctgaaggagaagaaaacagatgctaagcagcaagtgtcagggtggacgcctgcacacgtcaggaagcagcttgccattggcgttaacgaagttaccagagccctggaaaggagggaactgctgttagttctggtgtgtaaatcagtcaagcctgccatgatcacctcacacttgattcagttaagcctaagcagaagtgtccctgcctgtcaggtcccccggctcagtgagagaatcgc

SEQ ID NO: 26457 - DNA, 1483 bp, Homo sapiens
gtgccccgccagcggaggccgggaggaccaggaacccaggagagcatggccacgctgcgccggcttcgggaggcgccgcggcacttactggtttgcgagaaatccaacttcggcaaccacaagtcgcgccaccggcatcttgtgcagacgcactactataactacagggtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttacttacatttacgcttgctttcagatttcttaatggtaaaaggtctgtgtgtccactcaggcttgtgtgatggtgacatttctcagatcagcatttgctggcatcctgccctgcacctgagacccatctgtgatggcagcaaggcctgctgtccagtgaatagctcatagttgatttctctctgtcaacataagcacagggttgtgggttactatgtggtacactgggccaggatgtccagggaccggggatattggtccccatctcactccattggttgagatatattttgttcattacaactttttcagataataaaaa

SEQ ID NO: 26458 - DNA, 1042 bp, Homo sapiens
ggtacccagtctggagggagctgttgtcaggggcgttctggctgctcactcgtgtcaacccgccgaactgggagtttcatttctcattcctgaatgtgggatactatcggaagaactgaaaaacctggtcatgaacactggaccctattactttgtgaagaatttacctcttcatgaattaattacacctgaattcatcagtacctttataaagaaaggttcttgctatgcactaacatacaatacacatattgatgaagataatactgttgccctgctaccaaatgggaaattaattttgtcactggataaagacacttatgaagaaactggacttcagggtcatccatctcagttttctggcagaaaaattatgaaatttattgtttccattgatttgatggaattatccttaaacttggattctaagaagtatgaaagaatatcttggtctttcaaagaaaagaagccattgaaatttgattttcttttggcttggcataaaacaggttcagaagaatcgacaatgatgtcatatttttccaagtaccaaattcaggagcatcagccaaaagtagcactgagcacgttgagagatctccagtgcccagtgctgcagagcagcgagctggagggaacgccagaggtgtcctgccgggctctggagctcttcgactggctcggcgccgtcttcagtaatgtcgacctaaataatgagcctaataatttcatatcaacctattgctgtcctgagccaagcacagtggtggcaaaagcttatttgtgtacaatcactggcttcatacttccagagaagatctgtctcctattggaacatctctgtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataa

SEQ ID NO: 26459 - DNA, 1124 bp, Homo sapiens
ctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaagaaaaattggatggagattacagacagttcactcccttcccccagcatgggacctgcgccgcccaggtggatgcgctcaactcccagaagaagtactttggcagaagcctggaactctacagggagctggacctcaacaggtgggtgcgcccttcccccggctgcacttcccagtggggatctctgctgtcgcccaagcctgacagctggatccaggggagtgggtgtagacctcactgccctccagcagcttctgcatgtgcactattcggctactgggatcattcctgaggaatgttctgagcctaccaagcctttccagatcattctacatcacgatcacacagagtgggtgcagagtattgggatgcccatctggaccatctcatcatcagagtcggccatagggaaaacgaggactcaaccagcatgtgccgttctcagccatgattcctga

SEQ ID NO: 26460 - DNA, 1031 bp, Homo sapiens
ctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaagaaaaattggatggagattacagacagttcactcccttccccctcaactgatcttttgccagaaatgagggcatactggcctgacgtaattcactcgtttcccaatcgcagccgcttctgtgggacctgcgccgcccaggtggatgcgctcaactcccagaagaagtactttggcagaagcctggaactctacagggagctggacctcaacaggtgggtgcgcccttcccccggctgcacttcccagtggggatctctgctgtcgcccaagcctgacagctggatccaggggagtgggtgtagacctcactgccctccagcagcttctgcatgtgcactattcggctactgggatcattcctga

SEQ ID NO: 26461 - DNA, 1391 bp, Homo sapiens
ctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcaagtgtctcacacaagcagaagaggcttgctattcttatttaaaaatatctttagtctttctagcagaaatttctctttttattctttgcagacttcaatgaaaaagccaccccaaccaagcctaatatttcttattttctcttttaagcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttct

SEQ ID NO: 26462 - DNA, 887 bp, Homo sapiens
ttggtgctcccagcacctagcaccgggagactggagaggtttccaggagagtgacccgagtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcac

SEQ ID NO: 26463 - DNA, 963 bp, Homo sapiens
caggagagtgacccgagtaggtcccctcctaattctggagccgtccctcgggctgcgcagtggagcgccgaggtggcgggaggctgcggggagcctgggcggccaagcaccatctgcagtcaggagctcccgggcagcttgcagggcgcagtttttgaaagcgggtgctgcgtgcggaccgcgggcctgcagggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagac

SEQ ID NO: 26464 - DNA, 1375 bp, Homo sapiens
ctgcctcggcctctctgagccaaccacggggcggggcgtgaacgccgggcggggacgtgccgttctggggggcgtgtccaccggcgggggcgtgccgtcctgggggcgtggctctctgctccggtgcaggcccgcagggcgccctgggctgggagcaacgcgactgaccgtggtcgtgggcggacggcggctgcagcgtggaggagctggggtcgctgtgggtcgcgaagcagagcccgggacgtgcgcgcttggtgcacgatcctgaaggggagctccgaggggcccgggtcgccagggctgctgcggccattcccggagcccggcgcggggcccgcgagatactggtttaggccgtcccagggctccgggcgcacccggtggccgctgctgcagcggagggagcgcggcggcgcgggggctcggagacagcgtttctcccggaagtcttcctcgggcagcaggtgggaagtgggagccggagcggcagctggcagcgttctctccgcaggtcggcaccatgcgccctgcagccctgcgcggggccctgctgggctgcctctgcctggcgttgctttgcctgggcggtgcggacaagcgcctgcgtgacaaccatgagtggaaaaaactaattatggttcagcactggcctgagacagtatgcgagaaaattcaaaacgactgtagagaccctccggattactggacaatacatggactatggcccgataaaagtgaaggatgtaatagatcgtggcccttcaatttagaagagattaaggatcttttgccagaaatgagggcatactggcctgacgtaattcactcgtttcccaatcgcagccgcttctggaagcatgagtgggaaaagcatgggacctgcgccgcccaggtggatgcgctcaactcccagaagaagtactttggcagaagcctggaactctacagggagctggacctcaacagtgtgcttctaaaattggggataaaaccatccatcaattactaccaagttgcagattttaaagatgcccttgccagagtatatggagtgatacccaaaatccagtgccttccaccaagccaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaa

SEQ ID NO: 26465 - DNA, 878 bp, Homo sapiens
gctgagtgattgcagaaactggccttccatctctctcagacaccaagctgcagatccaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacacctgatttctgaagc

SEQ ID NO: 26466 - DNA, 1348 bp, Homo sapiens
agagacttgggttttgctccctaggagccctggaatagctttggccagaattccctatctcccattagaacctctcctttgcgtcctttgttaacctccaagtctacttggtgaaaacgcccacgaagaagtaacaaggactttgttcctagtgtgccaggtttgggcaccagtgctgtagtggctttctctgctgctccttgtgcatcagcagacagatgtggttcacataggaagaaagactaacgtaggcaaagatttgctctttcttcagcagccctagaaagacggcggcctgggtgattcaccactccttcctcacgtccttgattttatttgaactgagctccagatgctcctcccacccttttcctcttggaagccaaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacacctgatttctgaagcggttctgtctaggtactgtttctggcattgccttccagcaaggggtaagaactgtaaatctgattcactttggagaacggtgaatggagtaattaaatgccttcccttctgacttgga

SEQ ID NO: 26467 - DNA, 769 bp, Homo sapiens
gattgcagaaactggccttccatctctctcagacaccaagctgcagatccaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgag

SEQ ID NO: 26468 - DNA, 896 bp, Homo sapiens
ttgagcactgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagtcccatccctgcgtgattttgggggtgaagagtgggttgtgaggtgggccccatgttaacccctccactctttctttcaataaaacgcagttgcaaacacctga

SEQ ID NO: 26469 - DNA, 755 bp, Homo sapiens
ttccaagtaggggagaccagctgcccctgaaccccagaacaaccagctggatcagttctcacaggagctacagcgcggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattca

SEQ ID NO: 26470 - DNA, 720 bp, Homo sapiens
cccagaacaaccagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcacgtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattca

SEQ ID NO: 26471 - DNA, 1401 bp, Homo sapiens
accggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaaga

SEQ ID NO: 26472 - DNA, 1346 bp, Homo sapiens
tccaggttcacacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctg

SEQ ID NO: 26473 - DNA, 1790 bp, Homo sapiens
gcagatggtgctgtcgaccagtgtcaagaccaagtttcatgggttcctggacgctcagccaggggtagtctctgaagggccgcctggcaattgggagcagaagccagtttcccgccatctgctctccgtggaggcagtgctctcgcggctgctgcccgttggggtccagctgaggaaggagcgcggatcccaggctcgttctttgcctgggctgcccctgcggcccctggggcgggtgctgctgcggcgccagctccaagggcggatccaggcgggaggggcctcctcggagaagcggggcgcggtcccaactacgcagaggctggcacgccgaccctccacacctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctg

SEQ ID NO: 26474 - DNA, 634 bp, Homo sapiens
caagactcccccatgatgacctattcatccacctacctcctcactctgttccactgtctcccttaagagagatggcaccggccagagcaggatgctgccccctgctgctgctgcttctggggctgtgggtggcagaggtcctagtcagagccaagcccaaggacatgacatcatctcagtggtttaaaactcagcatgtgcagcccagccctcaagcatgcaactcagccatgagcatcatcaataagtacacagaacggtgcaaagacctcaacaccttcctgcacgagcccttctccagtgtggccatcacctgccagacccccaacatagcctgcaagaatagctgtaaaaactgccaccagagccacgggcccatgtccctgaccatgggtgagctcacctcagggaagtacccaaactgcaggtacaaagagaagcacctgaacacaccttacatagtggcctgtgaccctccacaacagggtgacccagggtacccacttgttcctgtgcacttggataaagttgtctaagccctggtgcccacgttccacctcacactctgcagactgtatgctgctgcttttcctccctccagttcgttattaatccttgctccccactgcaaatg

SEQ ID NO: 26475 - DNA, 1061 bp, Homo sapiens
gttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccatgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattctaa

SEQ ID NO: 26476 - DNA, 3586 bp, Homo sapiens
ttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggtttt

SEQ ID NO: 26477 - DNA, 1952 bp, Homo sapiens
ttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctga

SEQ ID NO: 26478 - DNA, 4398 bp, Homo sapiens
cccgggcctcctcccgctttctctctccgcttcccctggagcctccgaggagtccgcagccgctgggcgcccgggaagatggcggcggcggcgggagacggcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagagctcagttatgggtaatacttctaatttattccttcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatatccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctattatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttagtagtaaggaccgtaacccaccccttcctccccccaaaactatactgttatttttctatgtaagcaaattgtttgaaatgctttgaaaatgaaatcttaatattaaaaggcatatgcatgt

SEQ ID NO: 26479 - DNA, 4362 bp, Homo sapiens
cccgggcctcctcccgctttctctctccgcttcccctggagcctccgaggagtccgcagccgctgggcgcccgggaagatggcggcggcggcgggagacggcggcggcgaggggggcgcgggcctgggcagcgcggcggggctggggccggggccggggctgcgcgggcagggcccctcagccgaagcgcacgagggcgccccggacccgatgcccgccgcgctgcaccctgaggaggtcgccgcgcgactgcagcggatgcagcgggagctgagcaaccgcaggaaaatcctggtgaaaaacctgccccaggacagcaactgccaggaagttcatgatttgttaaaagactatgacttaaaatattgttatgtggacagaaataaacgaacagcttttgttaccttattgaatggggaacaagcccagaacgcaattcagatgtttcatcaatattcttttagaggaaaagacttaatagtccagcttcagccaacagatgctttgttgtgtattaccaacgtgcccatttcttttacatcagaagagtttgaagaacttgttcgtgcttatggaaatattgagagatgttttctggtctatagtgaagttactggccattccaaaggctatggatttgtggaatacatgaaaaaggactttgctgcaaaggctagactggagctattgggtagacagttgggagcatcagcactctttgcacaatggatggatgttaatctattggcttcagagctcattcattctaagtgcctttgtattgataaactccccagtgactacagggattcagaagagctgttgcaaattttttccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagaatctttctcatataccactggcacaacaacaattaatgaagtttgagaatattcatactaataataaacccggcttacttggagagcccccagctgtggtacttcagactgcactagggatagggtcagtgcttccattgaaaaaggagttgggacatcatcatggagaagcacataaaacatctagcctgattccaactcaaacaacgataacagctggaatgggcatgttaccattctttccaaatcagcacattgctggacaggctgggccagggcacagtaatactcaggagaaacagccagccacggtgggaatggcagaaggaaatttctcagggtcgcagccttatcttcagagctttccaaaccttgctgctggaagcttgctggtgggacaccataagcagcagcaaagccagccaaaaggcacagagataagttcaggggctgcctctaagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattcaaactagccatatcctttaaatacgggtttatagtttcccagaaggaactgtgttgtgcagcaggcagaaatgccaaataaaaaatagcaataagaagagacatcaattgaggacattttccactagagtcagatgcatcttaatcagtgtgctaacttacaatccattggagaaactaacaatgttccaatattccttgatttaggactgggaataattctgacaccatatataaaagaagtttgaagcaataaatgggaaacagtgttgtttcctgagccttagaagaatgagtttcttataagccaatgtgcatttcaatttactttccctagaagtaattgcatttatagatttttaggacttttcctagaactacaagggtgcaagtaccaaatgtgctgatggtaatattataaagatgctctacatgcacactcaattacgcccacaccagccatgcaaaattaaacccggtaagagagtgacagtgatatccaaggtatccactactaccgatgctttaagatgttgtttaccatttataccttctgtgaaaaatagaaggtattttaagaaaagtaactttggtgatctaataaaagggtttggcaaactacaccctgggtccacatttggtctaccacccgcttttgtgctgcctgcaagctaagactaatgtttacatttttaaatggttggaggaaaaaagaaaacttatgacatgaaatttatatgaaattcagatttcagtgtccataaataaacttttattgggacgttgccatgctcattcatttacgtgttgtctgtggcactcttacgctacaagggcagaactgattagcttcaacagagactgtatggcctacaaagaccatatggcctaaaatttcaagtatctggccatttatatatagtttgctgatccctgatctaatagcactaattctaatagcaactattcctttcaattcacctaaagacagacctttagcctttagacagacttgtaagtggaaaggaacatgggtttctgtgctcatttcatagcgtagactagtaatgatctaatgactagaatggggcctattttgatcactaaatgccctattatttccacaatatagtatagtaaagcagtcaatactgcactttctgatggagtcttaaggagtcacagtatttataaccattttgagctaataagctatacctcactctctgctttctctctcactctttttgatagtgtgttagggtgaaaaatcagttatttaacccaatttacttgtgaaagaagttttatctttatggactatgatgacttttgacatcaccatttcttgaagaccttggtattaaatgcatgagaaaccttttgccatctagaaatttctaagtttgtttatgttataagactgtaattaattgatagggaatttgggatctcaatccggggctttttgaaatcagatcattaaatatctcgtcactttggggacttgttatttttaactatgatgtggatatcctgttttaattatgaagtctagaattggtacatatgttgtatgctttgtaaagaatttcacttggtctaatttattgcatatactagcttctgttggaaaatgactgacagctagaaagtttaaggtaatttctaagtatactacctataagtaactgataagaattaggcatcattcagtgatatagcagatgactaatgggtttttcaggccctgcacttctctttcccattttcctgttgcattcagcctcttcaatgcttagtcacacctccactatagtacaaacaaacaaacaaacagaagaaaggaaagatggtgaattttgcaacagagctgcaaaaagtcagtcagtcaaagcaggaagaggttgaaggaactaaaacaaacaaacaaaggtgtctggactacagcacagtggacatgccatccatactggcctgtgccccgttatcaatcactgggcacaacagtgaagaagtgcaaatcaagtggtgtttgtttgtttgttagtagtaaggaccgtaacccaccccttcctccccccaaaactatactgttatttttctatgtaagcaaattgtttgaaatgctttgaaaatgaaatcttaatattaaaaggcatatgcatgtaaa

SEQ ID NO: 26480 - DNA, 893 bp, Homo sapiens
ccagtgtccataaacctgtgttttgccagcttgcacaggatgaaggtagttacgttggtggctttgcagtggttgaatatagcactgcggagcaggctgaagaggtccagcaggcagcagacggtatgaccatcaagggcagcaaagtccaggtttccttctgtgctcctggagcgccagggcgaagtacattagcagcattgatagcggctcaacgtgtgatgcacagtaatcaaaagggcttacttccagagccaaatccagtacaaattatgaaaagtttaaacaaccctgccatgttgcaagttcttctacagccccagttatgtggacgagctgttaaaccagccgttcttggaacacctcacagcttgccacatctgatgaatccatccatctctcctgcatttttacatttgaataaagcacatcagaatcaaacttcactcttgggagaaccaccaaaagaaattcggctcagtaaaaatccatacttgaatttggcaagtgtgttgcccagtgtgtgcttatcatcccctgcaagtaaaaccactcttcataagactggaattgcaagcagcattctggatgcaatctctcagggaagtgaatcacaacacgcattggaaaagtgcattgcttattctccaccttttggtgattatgcacaggtgtcatctttaagaaatgaaaagcgaggctcatcatatctcatctctgccccagaaggtggttcagtggaatgtgttgaccagcattctcagggcacaggagcatattacatggaaacttacttaaaaaagaagcgagtatactgagttaagctctctcctaataaccccctaaggttctctgcagtatctctgctgttcatcgctgccttaacttcattc

SEQ ID NO: 26481 - DNA, 3076 bp, Homo sapiens
gtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtga

SEQ ID NO: 26482 - DNA, 2863 bp, Homo sapiens
ttgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtg

SEQ ID NO: 26483 - DNA, 2325 bp, Homo sapiens
gatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttaaaaacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttg

SEQ ID NO: 26484 - DNA, 2381 bp, Homo sapiens
aaatgctgagtcagggtgtccgaggtggcgatcgccatcttggagtcttcaccggagtccaatcactgtgaaccaaaaacgaagtcaaataacaagtttcacactttgggaggccaagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctcgatatgtggatcaaggtgggaacaaggtatgctccatgaattgaaagtactggaaatcagaactaaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtg

SEQ ID NO: 26485 - DNA, 3673 bp, Homo sapiens
gctcctcacgcaatcctaaacggttcccgggcgaaccggggcccgcgcgcgccaaggccgccgagaccctcaggggctgcggccctggtcccgcgggacctgtgggggcctgggcggcggcgcccccgacccagccagcggacgggccggggggggaaccgggaggtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggtggacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacaaggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcatacttcagtcacccagtgtcttattctggcattgtctaaatctgagcattgtctagggggatcttaaactttagtaggaaaccatgagctgttaatacagtttccattcaaatattaatttcagaatgaaacataatttttttttttttttttgagatggagtctcgctctgttgcccaggctggagtgcagtggcgcgattttggctcactgtaacctccatctcctgggttcaagcaattctcctgtctcagcctccctagtagctgggactgcaggtatgtgctaccacacctggctaatttttgtatttttagtagagatggagtttcaccatattggtcaggctggtcttgaactcctgacctcaggtgatccacccacctcggcctcccaaagtgctgggattgcaggcgtgataaacaaatattcttaatagggctactttgaattaatctgcctttatgtttgggagaagaaagctgagacattgcatgaaagatgatgagagataaatgttgatcttttggccccatttgttaattgtattcagtatttgaacgtcgtcctgtttattgttagttttcttcatcatttattgtatagacaatttttaaatctctgtaatatgatacattttcctatcttttaagttattgttacctaaagttaatccagattatatggtccttatatgtgtacaacattaaaatgaaaggctttgtcttgcattgtgaggtacaggcggaagttggaatcaggttttaggattctgtctctcattagctgaataatgtgaggattaacttctgccagctcagaccatttcctaatcagttgaaagggaaacaagtatttcagtctcaaaattgaataatgcacaagtcttaagtgattaaaataaaactgttcttatgtcagttt

SEQ ID NO: 26486 - DNA, 3673 bp, Homo sapiens; identical to SEQ ID NO: 26485

SEQ ID NO: 26487 - DNA, 4931 bp, Homo sapiens
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctcttgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcactgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaagctttattatgtgtggtgtatctaaattttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttac

SEQ ID NO: 26488 - DNA, 900 bp, Homo sapiens
atgggcgacccggaaaggccggaagcggccgggctggatcaggatgaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 26489 - DNA, 420 bp, Homo sapiens
atgggcgacccggaaaggccggaagcggccgggctggatcaggatgagggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 26490 - DNA, 201 bp, Homo sapiens
atgggcgacccggaaaggccggaagcggccgggctggatcaggatgaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 26491 - DNA, 389 bp, Homo sapiens
atgggcgacccggaaaggccggaagcggccgggctggatcaggatgagagatcatcttcagacaccaacgaaagtgaaataaagtcaaatgaagagccactcctaagaaagagttctcgccggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaa

SEQ ID NO: 26492 - DNA, 3483 bp, Homo sapiens
agattgcaagttgcaggaccgctgtaggaaatgttattcgccgcggtcaggacaggcctgtccgcccgccctcgccgcagcctggcttcgtcgttgcgagcgccggggaggccgtccccggggagggcggaggaaggagctgactttgggtttgcgtcccgctcgctgctctgccccggggccagccaaggacgacgcttggaggcctcaggccgggagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctcttgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagatacactgtcagaaacttgagatcttttggcctatgataataccattaatttttgcattgcttcagtttgccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattagg

SEQ ID NO: 26493 - DNA, 2310 bp, Homo sapiens
gctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaa

SEQ ID NO: 26494 - DNA, 2137 bp, Homo sapiens
catcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgtttt

SEQ ID NO: 26495 - DNA, 1824 bp, Homo sapiens
gcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaagcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggc

SEQ ID NO: 26496 - DNA, 1828 bp, Homo sapiens
acccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggca

SEQ ID NO: 26497 - DNA, 2511 bp, Homo sapiens
gcgtcccggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 26498 - DNA, 1038 bp, Homo sapiens
gtttccccccaaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgagggtgtggagcaccgttctggaatcccgttcgttgtttagcaagagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagggtaa

SEQ ID NO: 26499 - DNA, 2348 bp, Homo sapiens
gactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccgagcggaagtcagcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtaggggatgtttttgaactaaatttcatgaacgtcaaattttccagtggttattatgacttccttgtcgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaataggaa

SEQ ID NO: 26500 - DNA, 1019 bp, Homo sapiens
cgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaaaaaagaaaaaagtccagattgtagttatacttttgcttgtttttcagtttccccaacacacagcagatacctggtgagctcagatagtctctttctctgacactgtgtaagaagctgtgaatattcctaacttacccagatgttgcttttgaaaagttgaaatgtgtaattgttttggaataaagagggtaacaatagg

SEQ ID NO: 26501 - DNA, 1073 bp, Homo sapiens
agcccgcggctcggactccggcgggacctgctcggaggaatggcgccgccgggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaaagcatgtacctacatcagatctaaccttgatcccagcaatgtggattccctcttctacgctgcccaggccagccaggccctctcaggatgtgagatctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcgagggtgtggagcaccgttctggaatcccgttcgttgtttagcaagagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatccttcacccctgtagg

SEQ ID NO: 26502 - DNA, 748 bp, Homo sapiens
cgaagttgaaggtgacaaccggtatattgcaaataccgtagagctcagagtcaagatctccactgaagttggcatcacaaatgttgatctttccaccgtggataaggatcagagcattgcacccaaaactacccgggtgacatacccagccaaagccaagggcacattcatcgcagacagccaccagaacttcgccttgttcttccagctggtagatgtgaacactggtgctgaactcactcctcaccagacatttgtccgactccataaccagaagactggccaggaagtggtgtttgttgccgagccagacaacaagaacgtgtacaagtttgaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggacagctgag

SEQ ID NO: 26503 - DNA, 520 bp, Homo sapiens
gaactggatacctctgaaagaaagattgaatttgactctgcctctggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattagttccagaagaaagatggaaattctgaaaactgaatgtcaagaaaaggagtcaagaacaattcacagtatgagaagaaaaatggaaaaaaaaaactttatttaa

SEQ ID NO: 26504 - DNA, 791 bp, Homo sapiens
tgttcctggatgagccacctccatgttgagcctgtaaaactggcctaatatgttctctatgagtcactgcattgctctgcaaatcagataaaacgtcactcgtaggttcaagcactgtcttcctgttggccctgacaatcatagccagcacctgggctctgacgcccactcactacctcaccaagcatgacgtggagagactaaaagcctcgctggatcgccctttcacaaatttggaatctgccttctactccatcgtgggactcagcagccttggtgctcaggtgccagatgcaaagaacagtccaggctctgcagacagcatcccacctgtcccagcaggctgacctgaggagcatcgtggaggagattgaggaccttgttgctcgcctggatgaactcgggggcgtgtatctccagtttgaagaaggactggaaacaacagcgttatttgtggctgccacctacaagctcatggatcatgtggggactgagccatccattaaggaggatcaggtcatccagctgatgaacgcgatcttcagcaagaagaactttgagtccctctccgaagccttcagcgtggcctctgcagctgctgtgctctcgcataatcgctaccacgtgccagttgtggttgtgcctgagggctctgcttccgacactcatgaacaggctatcttgcggttgcaagtcaccaatgttctgtctcagcctctgactcaggccactgttaaactagaacatgctaaatctgttgcttccagagccactgtcctccagaagacatc

SEQ ID NO: 26505 - DNA, 453 bp, Homo sapiens
tggcacctacactctctacttaatcattggagatgccactttgaagaacccaatcctctggaatgtggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaaaaaagaaaaaa

SEQ ID NO: 26506 - DNA, 1823 bp, Homo sapiens
atttccgggggagccgggggcgggacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgaggaataaccaagtgctgggaattggaagtggttctacaattgtccatgctgtgcagcgaatagctgaaagggtgaagcaagagaatctgaacctcgtctgtattcccacttccttccaggcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaa

SEQ ID NO: 26507 - DNA, 1281 bp, Homo sapiens
gcccgccagctcatcctgcagtatggcttgaccctcagtgatctggatcgacacccagagatcgaccttgccatcgatggtgctgatgaagtagatgctgatctcaatctcatcaagggtggcggaggctgcctgacccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagctttttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgcc

SEQ ID NO: 26508 - DNA, 2015 bp, Homo sapiens
cacacggccgccggaggcacagtcgtgttcgcatctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccaagctaaatttataatgaacagattgaagaaaaataaagagctacagaaagttcaggatatcaaagaagtcaagcaaaacatccatcttatccgagcccctcttgcaggcaaagggaaacagttggaagagaaaatggtacagcagttacaagaggatgtggacatggaagatgctccttaaaaatctctgtaaccatttcttttatgtacatttgaaaatgccctttggatacttggaactgctaaattattttattttttacataaggtcacttaaatgaaaagcgattaaaagacatctttcctgcattgccatctacataatatcagatattacggatgttagattgcatctcagtgttaaatctttactgatagatgtacttaagtaaatcatgaaaattctacttgtaactatagaagtgaattgtggacgtaaaatggttgtgctatttggataatggcactaggcagcatttgtatagtaactaatggcaaaaattcatggctagtgatgtataaaataaaatattctttgcagtaaaatattccctttgttaatgttatagaaggggggatacaaaaaggaactaacaatttgtatggcagtgtcagatatttttattttagtatttcctgttttggtttatttgcatcttagaagagcataatgacattgtttgatgaagcctaattatgctggactgttttgacctggtttaacccttctgataggtagttgtggatgctggggatgagaactgaataatctttgcctggagtgacactacactctagaatttccactttggagaatactcagttccaacttgtgattcctgatagaacagactttacttttctagcccagcattgatctagaagcagaggaatcccagcgccttttaaaagttgttatgtggttttcttttaaaaagctcctgtttttggaaagtagaatttatgggtacaacgtatgttcattatttgtacataaaataaaaccatttaaaaagtaatgctgatatttattctttaaaggcactaaacaaagatatgaaatattgatgacctggaagaagaaatcttcctccacacatcccatttaagtaggagatacatttaattaaagagaaatagatacttaatacttaatgttttgtgtttttacattgtttacagttttaagtatgttaaatacattaagtaacgatcagtttgcataatggtttttttagggtagagtttaaaatcagtaattcttagccttacataattataaagtaatggctcattttttgtttcagtattagatagtaaaactaaggctgtagaccagtccctggaccaagtgttaggagacctgagttccaatgtggttttgcctgggtattcttatttgtaaataatattattgattgaagattaggggaaatgatacatgtgaggaaagacatttgtaaaatttcttgggtttttactacataccgtattcattttttaaagaaataaacattttgaaagtta

SEQ ID NO: 26509 - DNA, 5830 bp, Homo sapiens
ggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacaggtaaccactgctgctactgtttttatttgtttgtttgttcaattttatttaagatttgtttttgttgtactaggattttaaaaaatgtaatatattgcaggatttataaccagg

SEQ ID NO: 26510 - DNA, 2236 bp, Homo sapiens
agcaagcgggcgggcggcgttcggtctgagggagcggggcggtctccgccggcgtcgcgcgcgctgtgtgtgagcggggtcgcgcgcgcgcgcggcaggcgagtgagggaacgaggagcggccgggtgtgagtgtgtgggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaa

SEQ ID NO: 26511 - DNA, 5392 bp, Homo sapiens
ggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgatctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcataaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacaggtaaccactgctgctactgtttttatttgtttgtttgttcaattttatttaagatttgtttttgttgtactaggattttaaaaaatgtaatatattgcaggatttataaccag

SEQ ID NO: 26512 - DNA, 481 bp, Homo sapiens
cttttcgctccccgcgcgcgatccatcgcctctcttcccccgaggccagcgatggctcggccgcccggcggcccgcgcttcctcgaaggccccagcccggctcagtcggccgagagcgagggaggagccccccgacccaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatcta

SEQ ID NO: 26513 - DNA, 555 bp, Homo sapiens
gtttacgccggtttctagggggcagagctggcgctatccaccccgcctgtatctccaaacccgcttcagccaggaaatttatcatgtggttttaaatttgcctctcaatatacagaggtactgtctttactccagtcccggataaagaccttctaggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaata

SEQ ID NO: 26514 - DNA, 2278 bp, Homo sapiens
agcgcctctttcccttcggtgtggtgagtaagcgcagttgtcgtctcttgcggtgccgttgctggttctcacaccttttaggtctgttctcgtcttccgttccgactctctctttttcgttgcagccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctgttctttggagaggaggatggaagggaggggtccggcacgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 26515 - DNA, 1284 bp, Homo sapiens
gcaattcctgacttgtactgccccagtggtgttacagcctcgaacccagtttccagacctaagtcaccgccggcatccagagtcccatgatggaaagggaggctaggttcccctgggaaggaccttgcaccactgctgcaagtgcaccccagaaatcgtcccaagcttttctcaaagggacctgcagccatttataaaagcgacatatcatcctggaaaacagaaatatacgtctgtcacagttaacggcaaagcctagggcaagagttctacgcccaagatggccagccggaagcgggcttctcgcgaccatgtggcgaagccccattcgtcagctggccgcccgcggccctggtacccggtcacctctctgatctgcgcatgtgctgggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtccaccta

SEQ ID NO: 26516 - DNA, 2318 bp, Homo sapiens
gggctacgcccgggcgcaagcgccaagagcggctgcgtctatggtcatgacgtctgacagagcgtccacccgtcttcgacaggactctatggttcttacgcgcgcagacagaccgcctatataagccatgcgcaggcggaggagcgcctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctgttctttggagaggaggatggaagggaggggtccggcacgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggcatatctgc

SEQ ID NO: 26517 - DNA, 657 bp, Homo sapiens
ggaggagcgcctctttcccttcggtgtggtgaccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccc

SEQ ID NO: 26518 - DNA, 713 bp, Homo sapiens
ccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggcctaccttgctctgccagtgctgggagacctccagaaacacatcgtagagggcgttcagctccttctctacggccttaggagtggtgtgcagcgggaccaacaccaggctgggaaggactgcaaggcccagggaccgagggctgccatccactcctggaccttctccccctagcccgtctgggtgaggaagcccccagtggagccagccagaactccccttctgctcccacataccaagcccacccttcccttcctaccattgctgggcaaagagaactgggccacaaatggctcccgggcaaagacgtcatcctcatcgttgtacacgtaggaactcaggacctgtgttttgtgtgacctgggaggacaaagggatgggcagcagtggccccacgtctttgattttggcttgcaagtgccaaacggcgctcag

SEQ ID NO: 26519 - DNA, 585 bp, Homo sapiens
tctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacagatccacatctcaaagaagtggggcttcaccaagttcaatgctgatgaatttgaagacatggtggctgaaaagcggctcatcccagatggctgtggggtcaagtacatccccaatcgtggccctctggacaagtggcgggccctgcactcatgagggcttccaatgtgctgcccccctcttaatactcaccaataaattctacttcctgtccaccta

SEQ ID NO: 26520 - DNA, 634 bp, Homo sapiens
aaggccctcggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtgcaa

SEQ ID NO: 26521 - DNA, 994 bp, Homo sapiens
caggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtatgaatatttaatcttttcccgctcctggtctgtgaggagaggggaatctttatttcatatgtggtatgttggtgttcacatgttgagttgcagctttgaatattgtctgcctttgtgttctcctcccccttggggaaatgtgcctcatttgtggcaaatgtaggggtgcagctctgaacaaggtggacaagatccctgctgttggggaacttgcagtcgaggatctgtaaagcacccacatggcttaaaggtggatgaaggaaactgttccctccagccagtgatttgaaactttggagagaggcagtattggtgccacatttggcctatgggttggttggctgcactgaggctgttctccccctggttcttcctatagaaacagctttgggtgatgcagtggtttgctcaggaagggggttttaacatagaaatgaccttttgtgttactgccgtgttttggtccaacaataaaactgaatagcctaaatcagaagtcctgactagtgtggaacctgaaagatggtggcaccctcattagacagacaagtaataagacttggatactcacaggatgttggaggaacagcacacctttggg

SEQ ID NO: 26522 - DNA, 721 bp, Homo sapiens
caggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaaggtaaagctgatttatctcaagtgaagtggtggaatgtgatgttggtgaatggagttgggatttggggatgcaaaatatagtactatttgctgggtatcttctttaaagttagaatattgggcatcttgacaaatcaggggcttccagggatgatggtttaaaagaacatccagaactaggccttctccctgtcaccatgaatgggggtagatggaagggg

SEQ ID NO: 26523 - DNA, 633 bp, Homo sapiens
ctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgga

SEQ ID NO: 26524 - DNA, 499 bp, Homo sapiens
gcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggt

SEQ ID NO: 26525 - DNA, 2221 bp, Homo sapiens
gctatcatcccagagtgcattgcggggccgcttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtga

SEQ ID NO: 26526 - DNA, 2385 bp, Homo sapiens
aggtgagggagactgggtcctggcctttgggcatcatccagcgccatcggcctggcgcttcagccaacgcgggagtggatgggccccttcttcttcgcagacagcgttcggccgctgcccgggctctaggcgcggccggacggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtggtga

SEQ ID NO: 26527 - DNA, 1457 bp, Homo sapiens
cctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcat

SEQ ID NO: 26528 - DNA, 2600 bp, Homo sapiens
tggaggagcttcacgcagtctggagctgaagggacacagcgagcgccccgacccgcgacgccccgactccgcgaaggcctccctgggaggctggggaagcgtcgggggatctctcagcgcagctctggggcccagatttctgcgcccgtcgtgcggtggccagagagggacagcgcagcgcggagacgcggagacgcagagactccgcagggggagagcccgcggtgcgtgaaacaaacctgttctctcctcagacctcaaagacagcggctccaccgcggtacgcggccaccggctttggagcctggaccccaacttgcctcctctcgcggagagacagtcgccgacgctcgcttagccgccgagacctcgccgccaactctctcacctctcgagacgcccaggccgctcaggctcgaatcttgcggagcagggggcgggacaatagcggccgcggcgccccactcggcagaactccgccaccaggcgcgatgccggaactacatgtcccatgacgctctgggaggccgcagctttccaccggaaagagggtggctgaggtgggggaggagcccaaaaggcattgtgggagtacagctctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaa

SEQ ID NO: 26529 - DNA, 820 bp, Homo sapiens
gggctagctgtccccggcagttggtgcagagccattttcattcccggcggtttccttgtttttgttggggaactaagatggacggatacagtcgtcttattgtacttaaagcggatgatatttaatacacagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtc

SEQ ID NO: 26530 - DNA, 562 bp, Homo sapiens
tcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggtaaatgctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttgga

SEQ ID NO: 26531 - DNA, 2053 bp, Homo sapiens
tgggagtacagctctttcctttccgtctggcggcagccatcaggtaggctgcgttgaggatctttgctcttccatccgcctttgatcgtcttcctcttcagccatccaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaagg

SEQ ID NO: 26532 - DNA, 830 bp, Homo sapiens
cctttccgtctggcggcagccatcagcggcatctcctttcaggtcctccttggggacgccgcctgccgcagccacccgcccccttggtgctcagttctggttctgttaattcgccccaccaaaacgtgccgagcaccgctctgtgctggggttgcggaagtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggac

SEQ ID NO: 26533 - DNA, 588 bp, Homo sapiens
cccgacccgcgacgccccgactccgcgaaggcctccctgggaggctggggaagcgtcgggggatctctcagcgcagctctggggcccagatttctgcgcccgtcgtgcggtggccagagagggacagcgcagcgcggagacgcggagacgcagagactccgcagggggagagcccgcggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcc

SEQ ID NO: 26534 - DNA, 650 bp, Homo sapiens
gggcgggacaatagcggccgcggcgccccactcggcagaactccgccaccaggcgcgatgccggaactacatgtcccatgacgctctgggaggccgcagctttccaccggaaagagggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttg

SEQ ID NO: 26535 - DNA, 1063 bp, Homo sapiens
cctttccgtctggcggcagccatcaggtaggctgcgttgaggatctttgctcttccatccgcctttgatcgtcttcctcttcagccatccaggtccggggaccctgcgtcctcggagataggtctccctcctgtgcggccagagtttggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaa

SEQ ID NO: 26536 - DNA, 1990 bp, Homo sapiens
caggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggtacgtgatcgactgcgttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtcttaaaaacatcttgggttacccactctgtccactcccataggctacagaaaaagtcacaagcgcatggtttccaaccatatgtgttttctgcagttatttctcttgttctggccaaacaaccctaaaaatccttaccattccacaaagttggaccatcacttgtgcacccactttgactatgagtataccaccacattgcatttctgtttgcaccatgtcttccaggagactagactactgttgtccagggtcaatttgagtgtaaagaaaatgtagacaaggaattgcccaattttaaattctgactttgctgacttaatttaaatgctcgttctgaaccaattttctcctatcttctctaggggtttcaaaagactcagttaattgatttccaggaagtactcatagcaagttcataaaagttcttgagacctaaatttcttcacaaaaaaagaaaagatcttaagtcatacattttaattgtgtagaggttgttcaactgaaggaataaatgtctattaaactaaaacaaa

SEQ ID NO: 26537 - DNA, 2500 bp, Homo sapiens
cagctctttcctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactggatggagtctcactctcactcaggtgggagtgcagtggggcaatcacggctcactgcaacctctgtctcccgggtttgagcaattcttctgcctcggcctcccaaatagccaggactacaggcgcacactgccatgcccagctaagttttgtatttttagtagagactgggtttcactatgttggccaggctggtctcgaactcctgacctcaagtgatccacctgccttggcctcccaaagtgctgggattacaggcgtgagccaccacccccagcccaatttttattttttgtacagacaggatctcactatgttgcccaggttggtctcaaactactggcctcaagcaatcctgccttggcctcccaaagtgctggaattataggaatgagccaccacaccgggcccaaatttactttagtaataacaacaattggctgggtgcggtggctcacgcctgcaatcccaacactttcggtaaccaaggtgggcttgagctcatgagttagagagcagcctgagcaacgtggtgagagcccatctcacaaaaaataacaaatcagctgggcatggtgttgcacgcctgtagtctccgaaatcacaccactgcactcccatcttgggtgatagagccagaacttgtctcaaaaataacaattggtttcttacaatcccaaaaggtgcagttactagtattaatccttttttgccaatgaggaaacacaaagatgaagcaacttgctcaaagtcatacagtgacagtctgaattcaaatcctatacacttaaagtttatttgttttgttttggttttttttgagatggagtctcactgtgtcgcaaggctggagtgcagtggcacgatctcagctcactgcaacccgggttcaagcgattctcctgcctcagcctcccgagtagctgggactacaggcacgcaccaccacacccagctaatttttgtatttttagtagagacggtttcaccatgttggccaggatggtctcgagctcctgacctcaggtgatcctcccgccttggcctcccaaagtgccgggattacaggtgtcagccactgcacgtggccaacttaaagtttttgatagataatacattaacgttaaaaattcaaaagataagtataggctctacagtacaaacccttctgcctcctagttcctctccctggaggcaaggtgatcagtttaacaatatttttttattttgagacagggtctcactgttgcccaggctggagtgtagtggcgcgttcacaacttactgtagcctcaacctcctggctcaagcaatcctcccacctcagcctgtcgagtagctggaaccacaggtgcacaccaccatgccaggctaatttttgtattttttgtagagacagggtttcaccatgttgttcaggctggtctcaaagtcctgggctcaagcaatcttcctgtctctgcttcccaaagtgctgggattacagatgtgggccacggtgcctggcctacatatgtattttttccttttcttccccaagtggtaggatatgatacacattgttgatttttttgtttagttatgtatctcagagcttattctttatcagctcatgaggaacttcatttttttttttttttttgagatgtagttttgctcttatagcccaggttggagtacagtaacacaatcttggctcgcagcaacttctgcctcccaggttcaagcgattctcctgcctcagcctccgagtagctaggattacaggtgcctgccactacatccagctatttttgtattttcagtagagacggggtttcaccattttggccaagctggtctcgaactcctgacctcaggtgatccgcccatctcagcctcccaaagtagtgggattacaggcatgagcaaccgtgcccggctggaacttcattcttttggtataactgcatggtatcccatcatgtggatgtaccatgattcattggatgtggaccctcctgatggacatttaaatttcttccaatctgttgctattacaaaaagaaaaatgtgtgcatacatctttattcatctgtagaataaattcttagaagt

SEQ ID NO: 26538 - DNA, 1345 bp, Homo sapiens
cctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagccctgtagatttgtctggtgcatgtgatgaaacctgcagctttatcggagtgatggcaatgctctgctggtttattttcaagtggctgcgttttttttagtttggcaggtgtagactttttaagttgggctttagaaaatctgggttagcctgaagaaaattgcctcagcctccacagtaccattttaaattcacataaaaggtgaaagctcctggttcagtgccatggcttcatggcattcagtgattagtggtaatggtaaacactggtgtgttttgaagttgaatgtgcgataaaattattagccttaagattggtaagctagcaatgaatgctagggtgggaagctggtgagccagtggccattagataaatacctttcaagtgtgagcttagacgtcaaccctaaaatacttaaccgtaatgctaattgtgatcattatgaatcccttcagtcacattagggggaaagtagttggctataagtacgtcattcttagtccagtcagtctt

SEQ ID NO: 26539 - DNA, 580 bp, Homo sapiens
ctctttccctaagcagcctgaggtgatctgtgaaaatggttcgctattcacttgacccggagaaccccacgaaataacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaagg

SEQ ID NO: 26540 - DNA, 927 bp, Homo sapiens
tacgaatctcgcgagaagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaagg

SEQ ID NO: 26541 - DNA, 678 bp, Homo sapiens
tacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaattaaaagg

SEQ ID NO: 26542 - DNA, 612 bp, Homo sapiens
cccacagggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaca

SEQ ID NO: 26543 - DNA, 441 bp, Homo sapiens
ctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtgagctggcgggggctgggcagacccatcagacccttgctgtactgtgctgtgctgtgctgtgctgtgctgtgctgtctggtccatcctcagtcttgccaccgctggtga

SEQ ID NO: 26544 - DNA, 1004 bp, Homo sapiens
actgggcccgccgggtcctccgggagccactgagaggccgtcggcgtcgggccagagcgtcaccgcgcgacgcatcgtgctagctacacgcatctcgctcccagatccctttcttccggaaagctatcgagaacacggcctgggtagggccagagaggcccccgacgtgctggcccttccctcttggacgttgcgcttgttcctgcgctctatgctctctgccgttatcgcccggctagtcagtcgtccaactcaccacagagaagtccggatcgtggtagagcgccgcgtcgcacccatgtgacgtcacggcggcgccactcgcttgaggctttccccgcccaccccagcccgttctctctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacagtg

SEQ ID NO: 26545 - DNA, 559 bp, Homo sapiens
tctctctttccggacctggccgagcaggaggcgccatcatgttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgaca

SEQ ID NO: 26546 - DNA, 618 bp, Homo sapiens
cttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggt

SEQ ID NO: 26547 - DNA, 1391 bp, Homo sapiens
ccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccgtcagcacaagccacgcttcaccaccaagaggcccaacaccttcttctaggtgcagggccctcgtccgggtgtgccccaaataaactcaggaacgccccggtgctcgccgcatgttttctttgcacactgcagagctcaaaggggtgctatgagaggccggcccagtcagctcctggggtgcagctgagctgccatttctttgtcctgggaggggtcttcagtgcaaacaaacaaaccctcacatcctcctgtcctggagtgggccctccaggcgcccccacccctgagctccctcttgcttggtcagttctcagccctgctggcagccctgggctatgagctgcaggggtactgtctgtcctgggccctaaatctgtcccaactgccttgtgagacacaggcctcccaggctcccctgctgagtctggaccagggagaatctccctagatagtggggttggcgttcactccctggggattctcctaagtctctggttcccaaagttttcagagtagacacaagtgggcacccgaggggcgctctctgctgcttgggggctgtttccctttcactggttgggggcctcttagatgacgccctcatcttgcccaaggaggtcaaggactcaccacaggtactcatctctgggaaactgcctcaggcctggaaaattccaggcatgacactaatcccaccctggctgagtccttctgtcaggtggaggctaagctggcattggagaagtttgagacacagccaagagctcaggctctgggagcctcccatcctttgttgcgtgaccttgggcagccctgttctgggccagcggcccttctggggcttgctgtcttgatctcaacatcgggttccacattgatgtgggaagtgacgctgtgcaggtgctggggtcagcctatggggccctcctttgtcccaga

SEQ ID NO: 26548 - DNA, 732 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgc

SEQ ID NO: 26549 - DNA, 616 bp, Homo sapiens
cttccaggtagggcctacgcgtggctcccgggcgctaggtgttcgacagacttgaaccgcgaccttgtggcctcagagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 26550 - DNA, 815 bp, Homo sapiens
gacgacggcgtcctcttgatcgcccttgaaggcccctttccgggctgtctgacacgatgcaagtgtcagcttgtgttggccggttgcctttctttcgcaagaggggaaaatatcctcacagactttctgtgttctcagagacgatcttcttccctagaaagaagtcgcttacggttggcgtttccctcaggcagcgccgtgggcagcccacaggcccttgtaaggcgcgcgccgcggccccgcctctttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 26551 - DNA, 806 bp, Homo sapiens
caggtagggcctacgcgtggctcccgggcgctaggtgttcgacagacttgaaccgcgaccttgtggcctcagaggtcgttcattgggaccgtggggagactctctaacctgtttgaggtccattggcatgggcgggttaaaccatgttctgccagacggggagcagcgtgcgccgggtcgggtctgggccgtgggctgagaaccggactgcgatgttgcggccctgcggggggacatttgcgagaaagacgagactgagtcgcttgggtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 26552 - DNA, 641 bp, Homo sapiens
gcgtggctcccgggcgctaggtgttcgacagacttgaaccgcgaccttgtggcctcagaggtcgttcattgggaccgtggggagactctctaacctgtttgagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaa

SEQ ID NO: 26553 - DNA, 2078 bp, Homo sapiens
cgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttgggaaccaaaatggtggtttatccttgtatctctgcagtgtggattgaacagaaaattggaaatcatagtcaaagggcttcccttggttcgccactcatttatttgtaacttgacttctttttttttctgcttaaaaatttcaattctcgtggtaataccagagtagaaggagagggtgactttaccgaactgacagccattggggaggcagatgcgggtgtggaggtgtgggctgaaggtagtgactgtttgattttaaaaagtgtgactgtcagttgtatctgttgcttttctcaatgattcagggatacaaatgggcttctctcattcattaaaagaaaacgcgacatctttctaagattctctgtgggaaaatgactgtcaataaaatgcgggtttctgggccattcgtcttactttcattttttgattacaaatttctcttgacgcacacaattatgtctgctaatcctcttcttcctagagagagaaactgtgctccttcagtgttgctgccataaaggggtttggggaatcgattgtaaaagtcccaggttctaaattaactaaatgtgtacagaaatgaacgtgtaagtaatgtttctacaggtctttgcaacaaactgtcactttcgtctccagcagagggagctgtaggaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgta

SEQ ID NO: 26554 - DNA, 392 bp, Homo sapiens
gtggccctaggcagctggggcgctttgctctccttcaggccggagagagagagccaggccaccgcgagagcactgccagggccctcgaaagtggcagtggggtgctggagagttgagatggcaggatcccgacgtgaatgtagacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcata

SEQ ID NO: 26555 - DNA, 625 bp, Homo sapiens
ccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttaca

SEQ ID NO: 26556 - DNA, 444 bp, Homo sapiens
ttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttaca

SEQ ID NO: 26557 - DNA, 2791 bp, Homo sapiens
gtttttgctccggccacgtgaggagggtgggcggggcgttaaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatatttgtaaaaaataaaaaaaaaaactaaacccattaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctacagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagactatatagttagatcctggacacacacatggattttgaggaatgatgtgagtttgtttatgtatgtacattttagcagttaacagatttggagtaaattgaatatttataaaacaacagtaattgccatgtaggtttactgtcatagtggaagatgattaagttgatggtacctacaggtattttgctatgaaaatgttttgacaaacaggatgatcgtgtaatttatgttccaagctctagtttgagaatggaagaatgtggtaaatttttgccaactgaacaggcataaagcgctgataataagggacttggccttaaggtaggaggttgttagcatttctttctaaacgtgtaagagtttatttaggtgacacccagcgttttggaaaaatgggtgtttgtttagaacaataatttggagggaagtggactaaacagggtttttagattaaggtttgtgtttatgtatctgtatctgcaaatactcagccataaatgtttctacctgtaagttgggtataatacaagctccacttggtatcaaaaaggactacccttagtgtcttccatgactagttatggaatgtaccagacctagagaggagttgttctaacctggagcttttgaaaatgtttccggtccataccctagaccaattaagtcagactgcagaataggactcagacatcagaattgtgaagctcccaggagatgtcaaggtatacccaagactgagaaccagtaccctgtctagactgaaccaggcttggttttagaagtattaaatctcgcctgggtacggtggctcacacctataatcccagcactttgggaggctgaggtgggtggatcatctgaggtcaggagagtgagaccagcctgtccaacatgttgaaaccccatctctactatacaaaattagccaggcatggtggtgcatgctgtaatcccagctacttgggaggctgaggcaggagaattgcttgaaccccggagatggaggttgcagtgagctgaggtcgcacgattgtgctccagcctgggcaaccagtgaaactctggggggaaagaaaaaaaatgtattaaatctctagttttagagagttacaccataacatccctgagtatggtcaatttcaagtcagctttagtgtgacaagcccctaggcccaccatttatgtctttatatattatggcaatatatgatccttatatattaaccactaatcgctgctgtttttgaatgttatcttttctgaggcagtcttgctctgtcacacaggctggagtgcagtaacaccactgaagctcactgtaactttgaactgctggacttggaatcctcctgctgtggccttcaaagggctgcaattacaagtgtgagccactgcatcccacctcacattttattctttggagattttttttgacttggattaaaaaactttatatttaca

SEQ ID NO: 26558 - DNA, 587 bp, Homo sapiens
cactggttggagctccatgtccccgggcctctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgac

SEQ ID NO: 26559 - DNA, 580 bp, Homo sapiens
ggccagacattcggttctgggaagctacatgcatccactggttggagctccatgtccccgggcctcgtggttttgcgatgggctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcacc

SEQ ID NO: 26560 - DNA, 683 bp, Homo sapiens
aggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatgggctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttca

SEQ ID NO: 26561 - DNA, 1562 bp, Homo sapiens
gttcgaccgagcaaatcctgctccagcactctagaacttagctgtatctaactcccgagtcaatccaaatgtgttctttcctcttggcagcgttcctgcctcctggcatggcaatcctcttccctgagactggcagttgctcaagataggaagctcccgggaccagacccgagcgccagccggctacgccgtccgctggcctgagcaaataaacgcgtgtcttcaaaaaactacaatccccatggtggcacgcgcctgtagtcccagctactctggtggctgaggcaggagaatggcgtaaacccgggaggcggagcttacagtgagccgagatcgcgccactgcactccagcctgggcgacagagcgctcaaaaaaaaaacaaaaaacaaaaaacaaaaaactacaacccccatgaagctttagtgcctttgaggggaggagtggcgcatgtttgttcacgcacgaaaaagaaattaaacctaactaccgttcccagagggcgccgctctgcaaattacccaatcagctctaagtacaaagcatcgcgagtctttagtgctctttggcgctataagcccgtgggaacgagcattggagacccttttcacaagatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggagta

SEQ ID NO: 26562 - DNA, 623 bp, Homo sapiens
ggggaggagatttccggcccccatccccgcagcgaccttataaggtctcttcccatgattctctctttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtggaaaacgctaaactggcagattagatttttaaataaagattggattataactct

SEQ ID NO: 26563 - DNA, 799 bp, Homo sapiens
tttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggtaattatggggtttctttactttcttgaacaatacaacaggaaaattttctttttttgagacggagtcttgctctgttgcccaggatggggtgcagtggcgtgatctgatctcagctcactgcaacctctgcctcccgggttcaagtgatactcctgcctcagcctcccgagtagctgggagtacaggtgcgcgccatcacgcccggctgattttttgtttgtttgtttgtttgtttaagtagagacagggtttcaccatgtcggacaggctggtcttgaactcttgacctcaggtgatctgcccacctcagcctcccaaagtgctggggttacaagtgtgagccactgagcccggctggaaaatttattttcagtctaaattgtg

SEQ ID NO: 26564 - DNA, 581 bp, Homo sapiens
gacataggtctcgcgagatctttggtaaacttacagaaccggaagcagcgtgtagttctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagag

SEQ ID NO: 26565 - DNA, 475 bp, Homo sapiens
tccttctttcctttttgctggtagggccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcatt

SEQ ID NO: 26566 - DNA, 4916 bp, Homo sapiens
cggctcagggctggcgcatttggtgaggagctcagacaacgaggcccttagggtcggcttaggcggttccctgaccaaggcgccagaaaagggcctggctcaagcaagcacgggcggcgtgcagtacagcacacctagccccgattcttcaacagttctcgccctccgagcctagcacaacgagcctcaccgaaaccgtacaccgccaccaggacactccgtgatgggggatcaccaccctcagaaagaggaagcgactagcaggcgcgcaatcccgcgagaccaggaggccccgcccgaagcccggcctctgtgaccggaagtgaggcgttttgccccgcccccgtggccgatacctcgcgagacttggcgaaggccttcctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcgggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtctctcttgccaggctggagtgcagtggcacgatctcggctcactgcagcctccgcctcccaggttaagcgattctcctgcctcagcttcctgactaactgggattacaggcgcccaccaccatgcccagctaatttttgtattttcagtagagatggggtttcaccatgttggccatgctggtctctaactcctaacctcaagtgatctgcccacatcggcctccaaaagttctgggattatagtgtgagccactgcgcccggccatggctccttaatcttgatccaaattattgttacatccagaatgtgatgaatcaaaatctcgagatgggggtccagcaatctgaaatttcagtatgccagggcttttctgtatgtcaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggttcttcctgtgattttgagctttttttgacccaaaataatacagtctaaaactatagacaaataagatggcacttagactcctgggttttagttagtggaggtttccttagtgcactgtggggtcataataagccgagaaccatggctgtctatgggacacatctgtcaggacaacctttagaggatgttggggatcaaatagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctactaaatacacaaaattagccaggcgtggtggcacatgcctgtaatcccagctactttggaggctgagccaggagaatctccaggaggcggaggttgctgtgagccgagatcgtgccattgcactccagcttgggcaacaagagtgaaactctgtccaccccccccaaaaaaagtaagggctctccattagggcccatagaggacttgtaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgatctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacttaagtgcaaactattacgggagcagatggagtcaattggccttcatgtgattgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatggctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggcactttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgagaaaaaaaaaaaaactaccagaacttgccgttgctgaaaagtaatattttctctttcgagagttttcatggccttttaaattacacccccacctccacaggcaaataaatttgttttggaatgcataccacatcatctggctctagaaacgtattttgtgtagctcccctagcaagaatataggttaaagcgtaaatttaattcctggctctattttacatcccaatttttattttcctctcattcccactttacgttgtttcaaataacctagtttgtgtatccctgtaagtcattttggtataaagtaggttataagtgtacatgcgaaaagatgtttttaacaaaaatgtaactga

SEQ ID NO: 26567 - DNA, 867 bp, Homo sapiens
cttcctttttcgtctgggctgccaacatgccatccagactgaggaagacccggaaacttaggggccacgtgagccacggccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtattt

SEQ ID NO: 26568 - DNA, 4796 bp, Homo sapiens
gggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattttcggcggaagcagccgaacatcatcgagccgcctcggaggtggggaccgacaactcctgtcgtgcccgcccggagaggaagcggaaatgcgtgtacggtattaaaggcgtcgcctcgcccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaa

SEQ ID NO: 26569 - DNA, 573 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccgagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattg

SEQ ID NO: 26570 - DNA, 590 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagatt

SEQ ID NO: 26571 - DNA, 510 bp, Homo sapiens
atgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctga

SEQ ID NO: 26572 - DNA, 616 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcatgatcacagatg

SEQ ID NO: 26573 - DNA, 852 bp, Homo sapiens
gggaggtgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctca

SEQ ID NO: 26574 - DNA, 1204 bp, Homo sapiens
ctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtgg

SEQ ID NO: 26575 - DNA, 695 bp, Homo sapiens
ttccggcgttgttgaccctatttcccgtgctgcaccgcagcccctttctcttccggttctaggcgcttcgggagccgcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 26576 - DNA, 742 bp, Homo sapiens
gcttatggtgagtgttggccgcgcggcatccgatgccatccgcgacttacgggtggcggcggggcgcgggctgcggagaggactggtgaccgaccgtgtgtctgtcgggagcaaaagctgcggggtgggaatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagga

SEQ ID NO: 26577 - DNA, 551 bp, Homo sapiens
acgggtggcggcggggcgcgggctgcggagaggactggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaa

SEQ ID NO: 26578 - DNA, 670 bp, Homo sapiens
tgccatccgcgacttacgggtggcggcggggcgcgggctgcggagaggactggtgaccgaccgtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 26579 - DNA, 537 bp, Homo sapiens
cgggtggcggcggggcgcgggctgcggagaggactggtgaccgaccgtgtgtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagta

SEQ ID NO: 26580 - DNA, 713 bp, Homo sapiens
cgcgcggcatccgatgccatccgcgacttacgggtggcggcggggcgcgggctgcggagaggactggtgaccgaccgtgtgtctgtcgggagcaaaagctgcggggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgctttgccaagaagcacaacaaaaagggcctaaagaagatgcaggccaacaatgccaaggccatgagtgcacgtgccgaggctatcaaggccctcgtaaagcccaaggaggttaagcccaagatcccaaagggtgtcagccgcaagctcgatcgacttgcctacattgcccaccccaagcttgggaagcgtgctcgtgcccgtattgccaaggggctcaggctgtgccggccaaaggccaaggccaaggccaaggccaaggatcaaaccaaggcccaggctgcagccccagcttcagttccagctcaggctcccaaacgtacccaggcccctacaaaggcttcagagtagatatctctgccaacatgaggacagaaggactggtgcgaccccccacccccgcccctgggctaccatctgcatggggctggggtcctcctgtgctatttgtacaaataaacctgaggcagg

SEQ ID NO: 26581 - DNA, 1442 bp, Homo sapiens
gaacgaaagctaggagcggaagagcgtgcgtggaaatggcgctcggtacgtgcccccgacctgtcgtctgccgcgggggcgcgctcgcacgccggaaggggcggggccagatttggctttatatagcggacccgtaaggccgaccggcctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactga

SEQ ID NO: 26582 - DNA, 1289 bp, Homo sapiens
cggtgatttttttcccacctagtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaca

SEQ ID NO: 26583 - DNA, 543 bp, Homo sapiens
agttccggctctgccgtgaagagctttgcattgtgggaagtctttcctttctcgttccccggccatcttagcggctgctgttggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 26584 - DNA, 575 bp, Homo sapiens
gctgttggtgagtgggctcctaccgaccgaggtttaggcagcgcggggagctttgcgggttgccatttgtaactccggatcctaaaattcctgtcctgttctctgtctcttctaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaaaagtaaaccttttcacctacaaaatttcacctgcaaaccttaaacctgcaaaattttcctttaataaaatttgcttgttttaaaaa

SEQ ID NO: 26585 - DNA, 1129 bp, Homo sapiens
ttttaaaaaattagacctgtttatcgcgctctcagtgcaaactcggctcacaagttcacgctaacacagtcacaaaaggcgagttttgggaaactcgagcagggcgccaccgttctccaggggacaggtaacttgggtgaccgcaggggtgaggacacagctgcttctaccaagcggagagtaaatgcgggtgctgcggcgcatcggagtcacccacaaggctctccaagagccgcgcctcaggacaaagatgaattcagcggcattgagaccgtggtcgcagccgccgcagcctcttctcatctaccctcccacctcaccttcagtcggcttttcgaactccctccgggttctaagcgcctcgattagttagaccgcagctcgcagcagaacagcaacacaacgccgcgaagcttaaaggcccgcagagggggaaaagaacacccccgccgtcattcttttttttccttctttgagacagagtctcactctgtcgcccaggctgagtgcagtggcgcgatcatggctcactgcagcctcgacctaccgagctcaagcgacctctccgcctcagcctccggcgtagctgggagtagctaggactactggagcgcgccaccacgcccggctaatttcttttttatttcttttttatttttttgtagagacaggggtggtctatgttgtccaggctggccttgagctggacgcaacagatcttcccgcctcaacctccgaaagtgctgggattaaaggttgggggccgtcccgctcctaaggcaggaagatggtggccgcaaagaagacgaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggaaatctgaaatagagtactatgctatgttggctaaaactggtgtccatcactacagtggcaataatattgaactgggcacagcatgcggaaaatactacagagtgtgcacactggctatcattgatccaggtgactctgacatcattagaagcatgccagaacagactggtgaa

SEQ ID NO: 26586 - DNA, 517 bp, Homo sapiens
ctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgct

SEQ ID NO: 26587 - DNA, 549 bp, Homo sapiens
tcttaccgccatcttggctcctgtggaggtgagtgaagggtctgctgctgaaatttgggggcaaataaccggagtaggtttgttcctgtgccttggcgagtcgccggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaa

SEQ ID NO: 26588 - DNA, 1437 bp, Homo sapiens
cttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatca

SEQ ID NO: 26589 - DNA, 691 bp, Homo sapiens
acttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaaggtatataattatgggtggaaggtgcaatctttttcatagctttattatttgaaaaggtgaacatctattcattgtggcatagagctcaggggtaatcctctaaaaatattagatctatagctaaagatatgtgaggtcttttgctacaaggaggaaaggaagaatgaggcagcttaacagcatggtgagtattttaggaacagataatgttcttaatggggcagtagttcatggcaaaatacaaaacaacttttttctgttctgttacagggccaagtgatccagttctaagtgtcatcttttattatgaagacaataaaatcttgagtttatgtt

SEQ ID NO: 26590 - DNA, 910 bp, Homo sapiens
gtcggggtgagtggaccaccctttaggcggagtccttccttaagctcccgcccgcggctccgaactgagtcctctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcacttcatttgtttgctgttcatcttttgggagggaataagctagagccatcaatacaattccgcttgtggggaaatttatgcctcttactggtactacttgttttgcattgaagctgactggttgagttcacatcatatgttgcaattttctaatttggcacttcaatcactaggggccttatgaggcagtttgtcattatgcaatggttattggttatcatgtgagtagacacatttcaggctaatagggagaagtcagtaacacattcatagtgaatatgagatgtctttgctaagagttaagtgtcagatctttgttata

SEQ ID NO: 26591 - DNA, 451 bp, Homo sapiens
gaggaagtgcgatcgggaacctcctatatacttccgtttgcctcgcggtttctttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttc

SEQ ID NO: 26592 - DNA, 746 bp, Homo sapiens
attggtttgcagtactgtcgctcaggtgcagttcccacttccgcctgtttcttccctttcctgttaggcgagagctgcgaaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagataagaagagaaagggccaagtgatccagttctaaactttgggatatttttcttcaattttgaagagaaaatggtgaagccatagaaaagttacccgagggaaaataaatacagtgatattcttacgcaaactttttgtggtttttacttataaatagaattccatgtttagtgtagtcccacctcaaactttactaacaagtttatatatgtatgaagggaaaatactactttactactttttgttttctggtcaatttcaaatgttgaatgaattcataaacattgagcagcttagaa

SEQ ID NO: 26593 - DNA, 7686 bp, Homo sapiens
ctcttgaccccacctacactacgacgacggacgctcgagaacgctgcaccgcgccccgcaggaagtgcttccctgggcggaagcttctgagcgtgatatagcggaagtgccttctcttccggtctttctggtctcggccgcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatgtttaaattacctttagcaacatgttcatctgctatgctgtcatgactagggggatgattattagtcacatagagcttgggagtaccactggaaacgtatgggtaggagtttaggtggcttctgtttttcaaaagatgatcttatcctagtatctgtaatgctcacttggcacacctgacttgtgggctgtgtgtaaggtggctagctaagtgaaaaaagcctgctaggtgtgagtcaacttaagaatatgtaaataggtttgagaaaaagtagggcttgggtgcaagtaaagattgagcaggaaataaaggaaaatcaagtataatccctgagatttgtagactaaaggcaatgatgtgggactacttggtcgaatttttttagccctcaacttggtaattgggtgtttctgtgttaaagcactgaaacttgctgtcgtgccttcctagttttcgtggtttattgacagggttgggggttttttttgtttttttaaaatgaagggacaaagtcaactggactgctgagtgagagggcaggggcagttgaagggaacatgaattgctggaacagctacataaaatagtgatgtagccaagtcatgctatttaaattataattctccactgtgtttagaataacatctgaggttcttaacctggccttggaagggtatcacttttacttgtaacctggaatggctttataatgtgctagctaattgctactctcatcttgtattttaactcctaatttacccttcaggtctcagcttcagaacattcacttataaagaaaccctgctgattaaatctctcttgggcttcctcccgaaatgtgagactatactttaaagatgtatggttagagtccaattgccattgcctttcttgtttacagatagtgcaatggcgcaatcctggctcactgcagcctctaattcctgggctcaagtcaagtggttctcctgcctcagccttctgagtagctgggactacagatgcacaccaccacacctggctaatttttgtgttttttgtagagatggagattcactcgactaattctttttgtattcttagtagagactgggtttcaacatgttgaccaggctggtctcgaactcgacctcgtgatccgccgcctcggcctcccaaagtgctaggattacaggcgtgagccaccactcccggctgtcatcatcaaattttcaagtgaagatagtctgttgaagattgaacaatgaccttgaaagacagctgagttgctgtgggtataatgtaaagctggtgaagtttggccagtttgggcttcagaagtctaagtctagtgaaggtaccctgacccccatataaacaacccttgaggccggtgtggtggctcacggctgtaatcctggcactttgggaggccgaggtgggcggatcacaaggtcaagagatcgagatcaccctggcccacatggtgagaccccaactctactaaaaatacaaaaattagctgggtgtggtggcatgtgcctgtagtcttagctacttgagaggctgaggcaggagaatcgcttgaacctgggaggcagaggttgcagtgagctgagatcatgccactgtgctccagcctggtggcacagtgagactccacctcaaaaaaaaaaaaaaatccttgaactaatgactcaaattttcaaatgaaacaaaataagcagtggatcttgcattggagatggagttaaactatgttgcccaggctggtcttggactcctggtttcaagtgatcctctcatcttggcctcccaaagtgctgggattacagggacgagccaccacaccccacctattgtctatatttctatctttaacagcacttcagtcctgccttaagttatagttatgtatagatacccattatactttaaatttttcagcagaaattatgcttttatcttctctgcagtgttatatgttggtgtgcaaaaatgttaaatttatttttcctaagtaccccatctgcttttcaactctgtcctctgcctgaaaagcctccctccagcccctacttccctcccatcttagttcacaaagtcaggttgatttgcccccagctgtcaaagcagactacctgtttccacatgtaactggttatgttctgtaaagttacaaaaatagaaaggttgaatctgtggcggccgggtacggtagctcacgtcctatagtcgcagcactttgggaggccaaggtgggcagttcacgtgaggtggggagttcgagaccagcctgaccaacatggagaaaccccgtctctactaaaaatacaaaaatattagccgggcgtggtggtgcatgcctgtaatcccagctactagggaggctgaggcaggagaattgcttgaacctgggagacggaggttgcggtgagctgcagaggcctcacctctaattgagacacaattatatattgttgatatatatatatatatatatacacacacacacacacactatgatggataaatgcatgagtttctgtgagagcattggaaaggagtttgtcactcaataggtgaagccaggctaagatttaagctgagccagggaggacttgaaggaatcatgatgagagagaaggtaagtggctttgccagcaatgaaacagctgacataatggtaaccagtcagaggagggcataactatgaaactggacaccttggttgtcaggttagaaggatggggtgtagggttggtaagaaaagaattcagggaagagcagcgatcagattatgaagaatttgtcttgagaaattacagaggatttaaaccagaatgttaggaatagttattctagcaagatgaatgtggaaagtgttagtgtgcatgtgatgagtcttgaagctggaaactaggtaacaggttcttaaatagttcatgtgaaaatcatgacagactaaggcagtggctgtggggctgtccgggagttctctacagaaaacatctaaaacttgaatgtgcaagtgagtagctaacttccaagcttcccatttctgtataatttaagcatgaaaatgagaacactgagatttgataggcatgtagaagtcagagtaagcaagagggcttgagttcatcgatgaacttcagtaactatccttgacttagtattggtggaaaccatttgtgaatttacagactccaaaaacaaaaagataatttagagtctcaaagtaagatttggggagatgtccattggagacagaagtggagagagggagaagttcatttgttgacatatttatgtatggtgcacctactgtgtgccaagccatgttagagatacagtgggagcaaaaccagatgtgttttctgccctctgactccagtggttgcagaattagcccaggaactagaattggatggagtcacacaaaccaaggaaggggattgtttgaggggggcactcagtcacatgtggctgaggccaaagagaatgaagatatattttaaaattctggatttggcaaaatttaggctagtctttacttttcataaacctctctcatgttagagcagcaaagaaaaaccagtttgccaagaggtcacgagattgggcagtgaggaatggggagtttagtttaaaagacaacactagatacttttggaagtttacctattctgtggttcccttttattgactaaatggtgcccttcattcatgaagcaagtatctatttagtgactactatgtgtcaaaagctatctaggcccagaaacttttaagtggaaaacaaaacaaagaccctgccctgacagatttcaatcatgtatatactgtatgtatgtttgtggaaggtgacataatagacaattgcagatagtgataagtgtgtaagacaaggataccacgagcgtaatagacagtggggatggaggaacctttagaaggttggttaagttgaatgataaggagccattcttttgtctttacctgaatgacttatcattcagccctttttgagttttgggttgcttgcagagtttaaccttgcctgtaattgaaacttaattttgtaatagcataacttcatgtaagaaaagcaaagcaatacattacagaattattttactgaagaacttgtttcagagaaagaggctgtttcacatttattagcacatttggattatatttaggtgttttatttttttttaaacaaaggagtttggatcataatacaagagaagcacagggcaaagacactgcataacctcaagaactaagaatggaaggactggccaggcctggtggtgcacacctgtaatcccagctactcaggaggctgaggcgagagaatcgcttgagcctggggggcagaggttgcagtgagctgagagaacggcgggcggcagagcgagactccatctcaaaaaaaaaaaaggataaaggaaggacttaagcaaaatcttccttgtaagtagaaggatgttttgacaagaaaagttgcaatggaaaaatggttctcatgtacacgagtatgtagaataagcatcgtgtgtggattggattcagatcaaaacattgcttttatgtttgtgtctttatacggtgggagtataccctggtgccccaggatgaagacttgacctgacccatgtatttttagattactcacagataacaaaaagtattttcatcatgattagttgcgaaaacagttttatttcaataggtaaaacgtgcagtcctatgtaatcgtcagaaggtaatcttaattatagcttgggtgtgctttaaactgcaagctggcagtggagggcacgattcctctgatttcagctttctccttatacttttctggagctgtgagctgcaagttaactcagtgggattaaagtgtagactggaggtacaaaaggtgaggagtgaggagatagggtagttcttccttggctggctggcttcataatccctgggccccgcagataattaaatcgactttttctgtctcaggcatttgtatgacctctttggaggttccctgctgggtagttatccttgtatctgatggacccatctcaatttaaaatactctgccaggttcggaggttcatgcttgtcatcccagcactttgggaggctcagaggtgccattggcttgagcccaagagtttgagaccagcctgggcaacctggtgaaacctcttctccattaaaaatacaaaaaattagccaggcatggtggtatgtgcctgtagtcccagctactcagggagctgaggtggaaggattgcttgagcctgggaggtcaaggctgcagtgaaccttgattgtgccactgcactccagcctggatgacaaagaccctgtctcaagaaaagtctgtaattctttcctaacccttagtatccagcctcagtcctgaggttttctttacctctgggggctattttatgccggctctctcctgagtgtcacacatctggtcctcaggaaacattctcacatccctggcctgaaaaaaacaatttcagggagatcgcatggcagcagccctctctgggctccccagctaaatggttgtacgaaacacatttcaaagctctctgaagggcttccttgaagttcctttcactgggtttcaaagtagaaggtagtaactcctttgtccaagaaggctgaattgagcacttaacaattctccaaagaaatttcttcattggtctctatcctagaccccttctgtatccttgatatggctgaggattctaaaaaatgaccagtcttacatgggagggctgggatataaaaaataaaataataaataatgataaaaactgaaaactgaccacgttcttggatatgttttctttgggttgtgtgtgtgtgtgagacttttgatagttacccaaagtaggaaaaatcccattctaataaggttatatttatgtagctctgcaaataaacatctagcaaatgtaaaaagtattttctttgccttaaaaatgattaaaattatttgaactcctgaggagtgttatatgaataaaattagtaagttatttggaggaaagttattttttaaaaagacaactggtaaaacagtacaggagaaaggccagcttcctcaagtgaggacagttgtttagaattgactgaggagcggccgggtgcggaggctcacatctgtaatcccacacgccttgggaggctctgaggcgggtagatcacctgaggtcaggagtttgagaccagcctggccaacatggcgaaaccccgtctccactaaaaatacaaaaattagccaggtgcagtggcacacacctgtaatcccagctactccgaaggctgaggcaggaggatcacctgagcccaggaagttgagactgcagtgagctgagattgcaccactgcactccagcctcagtgacagcgagactgtctcaaaaaaagaaaaaagtgactgaggaggaagaggccaggtggcaaatggaacagaatcaccaaagggtgaacaggactaaggcaatgtagtgtatggctcagctacgtcagagtggaaaaggtgttattagagcagaaactatggtccctgcgtcacagggaagcaacctacagagaagcagcagctccccaagagaggagagataagaagccagaagcctcagagtgaacaattgtcctattagggattgctctagagagagaaacctctgggaacgtacccctgtgaggcagcacagcacaatgcttttagaattgtatgagagttgatatatctccatttgttttgcaaaggcaaaaactaagatacagagattatctgttaaagttatgtatttctttggtaataaagatgctgacagtgttgctggaatgcatttctttaataaagatattgtacaatgaaa

SEQ ID NO: 26594 - DNA, 401 bp, Homo sapiens
gggccttcggagcgcgcggccagccctgggcactggtttcgttgggttgaatttagggaaaactaggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 26595 - DNA, 3112 bp, Homo sapiens
gactttcctcaggaaacaccaggctcttctgaattagtcgcgagcagaaccatcgtcctttccttcagaactctgaccagtttgaaactgtctaacttcttaatgtggctatatgatcgtttgcagctggcctgcaacttgttctgggaatggaaccttggattttagtcaccactgtcgctagcatcctgcacagtcagccacttttagagagcataatgcagagggggaaataaatgagatttggaatagagacggggtttcaccctgctggccaggctggtctcgaactcctgacccaccccgcctcccaaagtgttagaatcacaagcgtgagccaccgcgcccggccccacaaatgtaagatttatgcacttctccaagccaagtgctgtgcatcgaatggaggaactcgtacctttgcaggattttgtgatatatgtgaaataatccggacatgcttctgctatggttgtttgtcgccatagtttgcgaatctgggtaaacctggatgagagagacgccttacaattgcaaacatttctcaggaggccgcctgaaaacgcccaaaccatagagctcagttcctagctaggcctctaccagccacttccgctcgtccgcctaataccgcgcctgcgcaccgcgtctcttcctttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaacaaaattgccttggcttgttaactttattagacattctgatgtttgcattgtgtaaatactgttgtattggaaaagcatgccaagatggattattgtaattcagtgtcttttttagtagtcaaatggtaaaatgcagcataagaatataagtcttccaagttagatatgagtgttagctttttataagtctgctcctgccagtttgactttgagatacattggagccaactgtaaactttagtttttaaattacagttagtttttttgtttgtttttgaggcggagtctctgttacccaggctggagtgcagtataccagtcttggcccacttcaacctccacttcttaggttcaagcgattctcctgcctcagcctcctgagtagctgggattacaggcacgcaccaccatacctggctaatttttgtattttgagtagagatggagttttcaccacattggccaggctgttcttgaactgacctcaagcgatccacctgccttggccttccagagtgctgggattacaggtgtgagccaccacgcccagccttgcatttaatatttttataatgtgtctaggctgggtgcggtgactcacgcctgaaatcccagcactttgggtggctgaggcaggtggattacttgaggccaggagattgagaccagtgtggccaacatagcaaaaacccgtctcgacgaaaaatacaaaaaatagcttggtatggtggcacatgcctgtaatcccagctactttggaggctcaggcacaagaatcacttgaacctacgaggcggaggttgcagtgggccaggatcgtgccactgcactttatttagccaggacaacactctgtctccaaaaaaaagtttctgaaggtaaaagatatactaaaggatatacatatactgcctcttctatgatgtttcatttgacctacaccatcagcatcttcaggaaacagtatgaaactaatttcacattaaatgttgcaaacgtctgcaattctccagtttttagtttgcacgtaaggattcgtaggattgatttcagattgacagatggttgtagtaacaaaaaaatgaattgccttggagaattcgagttattttaggcctgcctttgacacttttatgcacttaattcactgccaatttagtctaactcctcaaccatctgtggtatggacttctcagtcctcctaattggtatgtcttttatctatcccagagtcagtagtcctttaaggatgcaaatttaattcgataagaatgtggatttacttcatctttaggacagagtaaaaacctttatttcacttggtctgacccctatcttctataacttgtttttttgctcattactggcctttgcacggatgtctcccttcacctgtacctcctgcattgcctctggcagaaacatcgctaccccaggagaatacttcactgggtcaggcatttgctagatccatagcagtaactcatctgtggatctcatttgtgtcacaaaatggtactcctactgattttgtaatgtgaagcaagtactgtgggtcagtaggggtaggaccaggagtgacaagtcaggattttcaggcttcataggaatgacacagctctccaggtgaatctcctggagaattctccataggatctccaggtgagtgaccaggatttcatgtaagcatagggaattgaatgagcattagatggtctaatgctgcggttaagaacaccaacttagccaaactgcctagatagttgggtgacttgggttaagtgacttaacctctctgcttcagtttcctgtataattcttggtagtagaatggagtatatgctgggtgtttggattattaatttggagtcttacaaagctgctatgttacatgattaggcatggaaaacttcggtttttataatcagtgaagtactgctttttgtttgttttctgagagagtgtctgtcacccaggctgaagtgcagtggcatgatctcagttcactgcagcctctacctcccgggttcaagcagttctcgtgcctcagcctccgaagtagctgggattacaggcttatgccacaaa

SEQ ID NO: 26596 - DNA, 1052 bp, Homo sapiens
actgcccggaaacggaagtctcgttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtctttttttttttttttttttctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgtggggttaaacataactggcagatgtgggagcgatggtggggcatgccattcaaacaggtcccaaaatgggtgcaacaaggtatagcacatctaccactcgctaacttgactgacttggagaaatgactacacttttgcctgtttcctcagttggaaaatagccatattaacacctctttcattggcttgctg

SEQ ID NO: 26597 - DNA, 431 bp, Homo sapiens
agtgcgaacgcctacatgagtcttgatcctcggcaggcaccgtacccagtttcctccgttgggagggtttaactgcccggaaacggaagtctcgttctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaa

SEQ ID NO: 26598 - DNA, 532 bp, Homo sapiens
gcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaatcctaagtgtctttcgtctttg

SEQ ID NO: 26599 - DNA, 756 bp, Homo sapiens
atcaccgccctagcatccggggaaatcgcggtcttagcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 26600 - DNA, 749 bp, Homo sapiens
cttttcagactcagcccgcctgcacccaggtgaaataaacagccatgttgctcacacaaagcctgtttggtggtctcttcacatggacgcgcatgaaatttggtgccgtgactcagatcgggggacctcccttgggagatcaatcccctgtcctcctgttctttgctccatgagaaagatccacctacgacctcaggtcctcagacggaccagcccaaggaacatctcaccaattttaaatcagatattttgcctgtgatctatataattttatgccagaagacttggactcaagcattaagatattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 26601 - DNA, 653 bp, Homo sapiens
tccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 26602 - DNA, 2321 bp, Homo sapiens
ggaaggtgacatatacagcgggagtggtaagcacttccttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttgagaagtgttctttttaaccagctataacaatagagttgagtattttcacccatggtttgaaaaagtgccagaaggccacactggcccacatctgtaatcccaacactttgggaccctaaggtgggcagagcacttgagccaatgagttcaagaccagcctggtcaacatgatgaaatctcgtctctactgaaaatataaaaaatagccagtcatggtgcatgcctgtaaccccagctacttggaggctgaggcaagagaatcacttgaacctgggaggtggaggttgcaatgagccaagattgtaccattgccctccagcctgggcgtcagagcaagactctctgaaaagtaccagaagcatttttcaggactgcctgtgtgtcttggtgattatgttaaccaactgtgttcaaaagaagtacccatgaaatgcctccagatataagggtgtttttttttacccataaagctaaactgcaaatattaccctagaattaa

SEQ ID NO: 26603 - DNA, 1277 bp, Homo sapiens
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgaaaagaagcctgcagagaagaaacctactacagaggagaagaagcctgctgcataa

SEQ ID NO: 26604 - DNA, 820 bp, Homo sapiens
cttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtg

SEQ ID NO: 26605 - DNA, 469 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 26606 - DNA, 699 bp, Homo sapiens
cgacacccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcttgtctattatgttttttatggttccatcgggtgggggttttctgtcattagagtttgccctgtcactacctgtgctatggagggtatcaaagctataaaggcaacagc

SEQ ID NO: 26607 - DNA, 677 bp, Homo sapiens
cgcaggatggtgagtggatgcctcggtctcggggctttagatgcatggaggttcccttttcttgcccgtatgccagcctagggcccgtctcgcgcgtcgcaggggccggatggcgttagattgctagctctgacttggtcgaggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacaggtaagaatac

SEQ ID NO: 26608 - DNA, 1010 bp, Homo sapiens
cgccgctgggcctgcaggtctctgtcgagcagcggacgccggtctctgttccgcaggatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaacta

SEQ ID NO: 26609 - DNA, 2325 bp, Homo sapiens
ccttttcccaccccctagcgccgctgggcctgcaggtctctgtcgagcagcggacgccggtctctgttccgcaggatggtgagtggatgcctcggtctcggggctttagatgcatggaggttcccttttcttgcccgtatgccagcctagggcccgtctcgcgcgtcgcaggggccggatggcgttagattgctagctctgacttggtcgaggtgcagttcccagcgtggccttaaatggctgccgcccggtgcgcgaacttggggggaggggttggcgaagaagggttgcgtgagcttggacggcggattggggagaagggtgagtttagtagacagcctgagtgcggatactgccgtctagtgtgaggggaacgccagaatggaggggggctgcaggtcctcgggtcccactcgacctccgagtaccgagtacttcgtgggttttccaggagaatgtcggagccggcaagtcttagatttaggaagcttgtgcccgtgggctgagcaagtggcttttaagccaaaattgtcagtggagcttggaggccgaggggtccctgggccccggaagctcctttaacatggaatacgtgcctcctgcctcttcctctagagtccgtcgccggatgagtttttaattattggggtagggccccaagggtgggatgaaatgttgctttagctgatggggaacagtgctgttttagtgggggaattactgctgaatgtgctcttgcccagttaagctttgtggcaggtaatttaggcttttgaaaaacataacatgggaagcgagagaggtacgtagttgttatttgaggctaggttttcgaagtgggacatagcgtgttccgaacaaaccgacgtttggcatcactgattgctgtctggagcagtgcttcgcaaaagtttggcacaattaccggtgctggtccttgaagaaacaaatatggaaattgaaagcgtttaaaaccttttgaaagcaatataacaataattttatacctgttaaatgtaataaattggggcctgcattttgtatgtttcttttattccatatttctctaaggattcatttttattgttttatgaaactactagtctgtgacatggaaggtagaggaaaaagattcttgaccctagttgcttgtgaaacctgggattctacaagtgacagttgtctgtttactcttgaagttcaagtgttactttgttacatggttaatttatgtcaaaagtatcataggctaagacatcaaagttttaataacattcttttttctttaaggggtttgttaaagttgttaagaataaggcctactttaagagataccaagtgaaatttagaagacgacgaggtactgtcacctttttgtgtttacaatattaatctgctttgcagatgcagtggagtatcctttctacaattatttttttctttcagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaact

SEQ ID NO: 26610 - DNA, 947 bp, Homo sapiens
atgattgcttatagaccggaagccgggaccttaattctctttcccatcttgcaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatag

SEQ ID NO: 26611 - DNA, 1074 bp, Homo sapiens
atcttgcaaggtaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaa

SEQ ID NO: 26612 - DNA, 612 bp, Homo sapiens
aaataatggttgtacggacttctgaccgctcagtatttggcaaaaaacctaataggtgtgaggtagtttcaaattctcaaaaaaaaagtttatagtgtattggggagacaaaccccaaatgagtcatagtgaaggttggagtagaatgggtagagtttgagaggaaggcctgtatcttaccgggggagggattgtagtctggggagcccagcccattcatgtacaggttcattattgtcttgttagagagatgactggtgaaatgcctttttttatctacaaaaaaatatttttagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccggg

SEQ ID NO: 26613 - DNA, 488 bp, Homo sapiens
ggtgggtgttagaggaagcggggagacggcgcgtgcactgtgttcctggtcctgggttccagaggatgacactgagcctgtcgcagccacgttggggttccgcactgaagccaaaaggtttcgcgtctcccagcgtccccgaccggaagtcgcctcttggtctttgcgatctttttctctggctcaatttgggctgattccgtttgtgtccgcaattcctaaatcgagtttcttgaaaagagacactggtcttaagggttaagacgaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagta

SEQ ID NO: 26614 - DNA, 588 bp, Homo sapiens
ttagaggaagcggggagacggcgcgtgcactgtgttcctggtcctgggttccagaggatgacactgagcctgtcgcagccacgttggggttccgcactgaagccaaaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaa

SEQ ID NO: 26615 - DNA, 682 bp, Homo sapiens
gtcagcggaggaccgagcgacggccgggaatggcagcgcgggggctccgcggaggcgccacgcacagtgtccaaagcatccttgcttcctcctggaaaccgcggccgccagtgaatcagaaccagaaaaaggctaaatgattcccagagacacagccatgaagcaggtggtttcgatctgaaaaaatcaaggtgaaaagctctagcaaccagaaagaaacgaatggaggaaaatggaaaacgcaagctagaagacagagtctcattctgtaggccaggccggaggacgggaatgagaaaggccatgtacaagaggaagtagtcagccgctaaatccaagatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatggtaagat

SEQ ID NO: 26616 - DNA, 425 bp, Homo sapiens
ggcctgtctgcaagacttgagttcaggactcccaatccttcgccatccgaacctggagggcatccagtcgacacctacagggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatggtaagat

SEQ ID NO: 26617 - DNA, 1101 bp, Homo sapiens
gcagcctggggattaggacccggagttgccaaggtgtcagcactctttgctcttgaattgattaaaaagtctaatcaaatgcatatattttcttcaaacaagttttacccgaaagtttgttgaaagaggctaaatcagggagttctttgcgtctgcaaggcggctttttagttctggattcttttccggcttattctaagacacctatgagtcgtggggcttctctcgcgaagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaata

SEQ ID NO: 26618 - DNA, 680 bp, Homo sapiens
ccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 26619 - DNA, 891 bp, Homo sapiens
tttcctttctctctcctcccgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctgggtcctaagtctgtggctcgtatcgccaagctcgaaaaggcaaaggctaaagaacttgccactaaactgggttaaatgtacactgttgagttttctgtacataaaaataattgaaataatacaaattttccttca

SEQ ID NO: 26620 - DNA, 1057 bp, Homo sapiens
tgagctgtagttccgtggcactatagccaggttccggctgtatccgctgccatcctcctccaggcgcggcctcggagggcctcctgctcctcctggcgctaggagagccccactcggtgtggcacggagacaccgaggtggattagagccccacttggtgtggcacggagacattgagatggactagagccccgggcggccgagagcggaatgcgttgttcccggtgtcgcagggctgggtgtcgcaggcctggagcaccgcagtgcggggctcggagccctagcgtctctcgggcttgctgggggccgctccagaggccttgtgagcgacgagttctgagcccgcccctgttgcttctagagcctgtggggccgcgactcagaggagtcatgagtccggggtgtctcctgggtgggcgacgcgaagagagcgtggtctcgggcttagccttgctctggccactcggggttcccggggctgcatgcttgtgcggctgaatgtgagatgctcctgtcgaggggtggtgctggggggttgcagaaagctgctcgccagcttagttcagccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcga

SEQ ID NO: 26621 - DNA, 1041 bp, Homo sapiens
accaggacaccttcagccgcgtctcctggtgcgcctgcgcgggggccctggaggaggagaagtaggcggggccggcggccgctggtgactacaagccccggcgtgcaccgcgctaggctggccgtggcgcgcccggaaggtgtcgcggccctgggccccgccccggaagataaggccgctcgctgacgccgtgtttcctctttcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcc

SEQ ID NO: 26622 - DNA, 965 bp, Homo sapiens
tctttcggccgcgctggtgaacaggtaggtcatccttgcggccttgcggcatgggcagtatccgccgccatcctcttccgtgaggcgcgctgagacccggaccggccctcctgagaggatgccggtgcgggcgcccgcggagagggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgcca

SEQ ID NO: 26623 - DNA, 750 bp, Homo sapiens
acgcgatacaagtacgtaatgacgacagacgttctttctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaccttcttcttaaa

SEQ ID NO: 26624 - DNA, 640 bp, Homo sapiens
ctttgctgcgtctactgcgagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgg

SEQ ID NO: 26625 - DNA, 1127 bp, Homo sapiens
aaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgga

SEQ ID NO: 26626 - DNA, 689 bp, Homo sapiens
agacgttctttctttgctgcgtctactgcgaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatgtcgacattactctgaagggacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatatatccgcagggttcggatgagaccaggtgttgcttgttcagtatctcaagcccagaaagatgaattaatccttgaaggaaatgacattgagcttgtttcaaattcagcggctttgattcagcaagccacaaca

SEQ ID NO: 26627 - DNA, 644 bp, Homo sapiens
ggcggggggcgggtccacgccagcccggaagagacgcagcaccgcgcatgctccttcctttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaa

SEQ ID NO: 26628 - DNA, 609 bp, Homo sapiens
acttcctctccagcccctgcgtaatcgataaggaaacccggacgctgctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcc

SEQ ID NO: 26629 - DNA, 631 bp, Homo sapiens
gcctcaatccggaaacagaaactccccaggcccggcactgcgggagccacctctttcgagggtgggagtgcacatgcgcacaggggacctgaaaaacccttaaataccggcatgcgtgcggatgaggcctctttccctgccgccgccgagtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcaca

SEQ ID NO: 26630 - DNA, 646 bp, Homo sapiens
cacacagacgggcggtggctgcgcagcgtagctccgcctcctgcgtgagaggaagcggggacgtgtgaggtcacttcctgcgtgttgggtggcttcctgcggcgtttccactctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagcaataaaatgattgtttaactaaaa

SEQ ID NO: 26631 - DNA, 711 bp, Homo sapiens
ggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaaaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaa

SEQ ID NO: 26632 - DNA, 1599 bp, Homo sapiens
ctcccactctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttcaactccagccttctctccttcatcaggggctactcaggcatttgatttcttcctcctatttggcttcttgggagaaaggagcctgaggagagctgagatcctggtgctgcatttggggtcttttccatgctacttgcggcattaagttgccttggtcatctaaagcagaccaaggcgttggagacctcgttttgagtggagatgctggttctaaatatggaccaattcttaaagagccagagtgggaactgttgatccaagtgtagcctgaagcgaaagaggagccttccagacccatgccatatataaacacacgtgggtgtgcattctccccccacaccttctgtgcaaagctgggagctcactccactgcgtcttgctttttttcacttggcagatcttggagattgttccacatcagtacataaagtacataaagattgtcaccccacaaatacacaccaagtcctattttcatcagcgataaaaaagaaaagttcttgctttccggaagcttgcatgcggctctgagtacccagtgacaccagatggtactcagcgttttgcaagggattaccacaaggccccgtgatggtgcctgccatggttaggacaggctggtggctgggtagggttagtgagacccagtggagaggatgctgtgtgtcacaggctggagaggtgagaccattgaggtagtcagttgtagaggaaagaaaccagcaagaggggaaaatctgttgggatgctgcttttagcctttgatggcgtgttccaggcagagggaataagcaaataaatgggtcctgagacaaggggttactgtgatgaggcggcgttggttacatgccaaaccttgctagggattttaataacaacattgaatcttaacctgatgaaataacagtactcctggggaggcgggagggatagcattaggagatatacctaatgctaaatgacgagttaatgggtgcagcacaccaacatggcacatgtatacatatgtaacaaacctgcacgttgtgcacatgtacccta

SEQ ID NO: 26633 - DNA, 784 bp, Homo sapiens
ctccgccccctcccactctctctttccggtgtggagtctggagacgacgtgcaggtaggaggcccgggcgcgacaatcggggggcatcctgcggcgaggggaccctgtggggcttgggacgagagacgggggtctttccgtgggaaccgagctaggtgccgggcaagagacgcgcggctggcccacctggatcctggccaactcgggattgagttcgttcctggtctcagaaggcccgttttgctttcagggaggagcttgtgaagtaaggaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtttc

SEQ ID NO: 26634 - DNA, 592 bp, Homo sapiens
gttaacgcactgggtcgtgctcattggtctgatttgaagataggaacatttaacttcgtacacccaagacttacacttgaaaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaacaagattcctcaaaatattttctgttaataaattgccttcatgtaaactgtt

SEQ ID NO: 26635 - DNA, 531 bp, Homo sapiens
ggcagtctcgcgataactgcgcaggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcc

SEQ ID NO: 26636 - DNA, 1082 bp, Homo sapiens
ggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactccagtcctttgcgcagcttgttcttcctggcgtcccgagctctgggaggggcctgggcctgcttcaggttcgtggtgtgaggaggttcaggttggacgttcgggggtgtgtggtagtgttgtgtggatggtctcttggtgtcgaagactgacagctgtgcgggccctgccccaactcggctgcccctgctcctgtctgcagggacagctgtggagctgggtgcccaagcccaggtgtgtagctccgtcccttttggccccctcagcgttcttgacctcggggcagctgcctggcctcactctgtcttctgggtacctcacgtagagggggccactcctgggctaagtgcagcccctcaagccctcacctggcctgggctctcctttctggcttccctcatctcctgtggagggttcccgcaggaagtgaagcagcagcaggaacctttgggccacctgagcccctcccttctatcctcacccctgcttggcttcttagaagctcctgactctcctcctgacaccacgctgctggcatctcctctcccagcaggctccatggctgcagccagcccca

SEQ ID NO: 26637 - DNA, 2203 bp, Homo sapiens
ctctttccgccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagtttttttttttttttttcttttttggagacagagtctgactctattgctcaggctggagtgcagtggcgcgatcttggcccactgcaacctccacctcccgggttcaagtgattgtcctgtctcagccgcctgagtaactgggattacaagtgtgtgtcgccacatccggctaatttttatattttagtagagacagggtttcgccatgttgcccaggctggtcttgagttctgggcctcaagtgatcagcctacctcggcctcccgaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatatgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcagcatccgtatctgtaatgggaatgatacaaaacctatccccaagttgagggaaaaatgagattgtgtaaagcgcacttggcacatgacagtcacaagcatggggacagtgagtccagaaggattttcttatgccagcattgtaagccctaggatcacagggctctggcttgtttaaccatcgtgtctctggtccctagcctgcaaacctggtgtgtagggatgcctcagtcgcttacatgttgattgagtgaatcgtcggtttctttctggacactgacttcaaaaataaaataggatatgaaaatgg

SEQ ID NO: 26638 - DNA, 797 bp, Homo sapiens
ctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaaattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctg

SEQ ID NO: 26639 - DNA, 585 bp, Homo sapiens
gaaaagcggccagggtggcccctagctttccttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttc

SEQ ID NO: 26640 - DNA, 638 bp, Homo sapiens
cggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatggtgagtcccaggaactgggcgcatggaggaggtggctctgggagggaggccttcacagcgctcctgtaccctttaattgtgtgtctttctcacagctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttc

SEQ ID NO: 26641 - DNA, 595 bp, Homo sapiens
actccgccagggggcgctgtgtggctcccgagtaggctcagagcgaccgtggccgggcggaagcggctttctggcctaagctttaacaggcttcgcctgtgcttcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaaccttcaggtcactcagcctacagttgggatgaatttcaaaacgcctcggggacctgtttgaattttttctgtagtgctgtattattttcaataaatctgggacaacagcctt

SEQ ID NO: 26642 - DNA, 613 bp, Homo sapiens
cttctcctagatcgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 26643 - DNA, 613 bp, Homo sapiens; identical to SEQ ID NO: 26642

SEQ ID NO: 26644 - DNA, 613 bp, Homo sapiens; identical to SEQ ID NO: 26642

SEQ ID NO: 26645 - DNA, 212 bp, Homo sapiens
cttctcctagatcgcaccgcctcttcctcctggaagctatataatgatatcgcgtcacttccgctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaag

SEQ ID NO: 26646 - DNA, 613 bp, Homo sapiens; identical to SEQ ID NO: 26642

SEQ ID NO: 26647 - DNA, 613 bp, Homo sapiens; identical to SEQ ID NO: 26642

SEQ ID NO: 26648 - DNA, 589 bp, Homo sapiens
ctctcttccacaggaggcctacacgccgccgcttgtgctgcagccatgtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 26649 - DNA, 685 bp, Homo sapiens
cacgccgccgcttgtgctgcagccatgtctctagtgatccctgaaaagttccagcatattttgcgagtactcaacaccaacatcgatgggcggcggaaaatagcctttgccatcactgccattaagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 26650 - DNA, 654 bp, Homo sapiens
cttctcctagatcgcaccgcctcttcctcctggaagctatataatgatatcgcgtcacttccgctctctcttccacaggaggcctacacgccgccgcttgtgctgcagccatgtttactgtgtctgatttcttcccccgtactttttcaactagtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtggaacgtgtgatcaccattatgcagaatccacgccagtacaagatcccagactggttcttgaacagacagaaggatgtaaaggatggaaaatacagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgg

SEQ ID NO: 26651 - DNA, 685 bp, Homo sapiens; identical to SEQ ID NO: 26649

SEQ ID NO: 26652 - DNA, 589 bp, Homo sapiens; identical to SEQ ID NO: 26648

SEQ ID NO: 26653 - DNA, 847 bp, Homo sapiens
gtactttcgccatcatagtattctccaccactgttccttccagccacgaacgacgcaaacgaagccaagttcccccagctccgaacaggagctctctatcctctctctattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgt

SEQ ID NO: 26654 - DNA, 2359 bp, Homo sapiens
gtactttcgccatcatagtattctccaccactgttccttccagccacgaacgacgcaaacgaagccaagttcccccagctccgaacaggagctctctatcctctctctattacactccgggagaaggaaacgcgggaggaaacccaggcctccacgcgcgaccccttggccctcccctttacctctccacccctcactagacaccctcccctctaggcggggacgaactttcgccctgagagaggcggagcctcagcgtctaccctcgctctcgcgagctttcggaactctcgcgagaccctacgcccgacttgtgcgcccgggaaaccccgtcgttccctttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattagaacaaaccatgctgggttaataaattgcctcattcgtaatcctggtctgggtctcttttttgagtctcttgctctgtcgcccaggctggagtgcagtggcgccatctcagctcactgcaatctccgccttctgggttcaaatgattctcctgcctcagcctcccaaagtgctgggattacaagtgtgagccactgtgcctggtctggtttgggtctcttgattgttcttcaggggcatgaggaagaggcgcttcctcccttcccttgggtgagggggcccagggtgattgggtggctgtttacccggcagccagtcgggccttcccaggtcaaacagttcccatctgggtttggaggaaggacccaggggcccttgtggctcactcccccacatcctgtctttgcaattgtcagaaagtgagaaacgaaaggatggctgtgagctgtgacctcagctgggcctgggctgcagaggtggcttccgctggagtaaagcaagagggcccagggttcatgctcttccctggaaggtagaaaaggacagaccaccagggagcctccaccgcaaactgacctgtgctgcctacacactaactttcctgggcctggggcctgcacaggctgaatggtccttgagccttcactctgcatctgagcggtcttgggcccgctgagtggcagtggcaggaagtcggtggaagcagatccctgtgcagaagttgaattaccagggcggccacacacgggctgcacaacctttgcagtcgtgcacggcaagtgggatgtggcctccgcccatgattgggcacctggtcaggctgggagatccaaatagcacccagtgggcagctgtccgacccctggaggggcaagccaggaaagaaacttagggcccgctgtgaccagatgtccctcccagttgggaagactaaactggtttggccaatatctcccaggattcccctgtccaaattattcctgggatctgacccatttcctggaaaggggcgagcctgggttttgaagttcaaactagagtttaaatcacaactctgcccctaatcccacgtaaccctgtgcaccttatcctctgagccttcgtctcctcgtgtgtaagcctgctaactcctgagagactggacaagatgccgtggagagccttggctctgagtagctctgctgctggacagttcagttggcagtccccaaacgtaaggcgtaagagtttaagaagtatcggccaggcacagtggctcacacctgtaatctcaacactttgggaggccgagacgggctgatcacctgaggttgggagcttgagaacagcctgaccaacatggagaaaccctgtctctaaaaataccaaaattagttgggcatggtggcgcgcacctgtaatcccagctactcaggaggctgaggcagaagaatcgctcgaaccccggaggcggaggttgcagtgggttgagatcgagcaattgcaatccagcctgggcaacagagcgagactccatttcaaaaaaagaatcaataaaaatgttaaaagcac

SEQ ID NO: 26655 - DNA, 927 bp, Homo sapiens
ggcacttccgcccatccccctccggatccctctgttcgggctcgggtttccgccgagacgacagggactgccaggtcggaagtagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattcaggcccagaaactgcggaactcggccaagggaaaggtgcccaagtcggcactggacgagtaccggaagcgagagtgtcgagaccacctcagagtaaacctgaagtttctgaccaggacgagaagcaccgtggctgagtctgtgagccagcagattttgcgccagaaccggggccgcaaggcctgtgaccggcctgtggccaagaccaagaagaagaaggctgagggcaccgtgttcaccgaggaagacttccagaagttccagcaggaatacttcggcagctaggctccctggagggcacggtgaagaggccttcaagccctgcagcctccgactcctgctggctccaggaaccggccgtgccgcgcggccagcagatggcgatgcaggaccagcctggctcgaggaagccgcggagctgagccgagtggaggctggaatggagctggtgggccggaagtcctggggaggatttacacacagaccggagctggcttccgcaggcctgggcagagcatctgcacctgccggaaaggaacgtatctgttttgtttgcttttgcccaggtggggcctctgggctgtttgctgtggagcaaggctaattcctgagcccttggggacgacagctccaggagtaggaagaagggtgggcttccaagttacaataaatgtgaacccaaga

SEQ ID NO: 26656 - DNA, 976 bp, Homo sapiens
gtgctataaaagctgcttcccagtaggtctcgttcttcttttccgacaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 26657 - DNA, 924 bp, Homo sapiens
agtcctgttggtcgctgcagcgggcctctgcgtgggcggcgggaatccgcggacatcgggtcgggtctaggctcccgagtccgcgctcctgggcgggagcccttgtctgggtctcgcggggggctgccagatgcgtaggccacactgactagttccttcttgtcgcttttcccagcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgt

SEQ ID NO: 26658 - DNA, 1030 bp, Homo sapiens
agcaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggtacccggctgtcctggagggggctgcgctgggcttgccgggactctctcggctctgcatagttgcacttggcttcacccgtgtgactttcgtaacggggagagagagaaaagatctcctcaggacctcggatgggccttactgtggcctctctttccttgaggggtgcaacaggccctgggcggtgggcagtgattgggtgtagggccaccagctgcctcacacacatcttttcgcaggctccctcgggcccccgtctcctgactccttccctcaccaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 26659 - DNA, 625 bp, Homo sapiens
gtcaccaagttgggccgcttggtcaaggacatgaagatcaagtccctggaggagatctatctcttctccctgcctattaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtg

SEQ ID NO: 26660 - DNA, 626 bp, Homo sapiens
ctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttctgttggtttttattcagaatactggcagattttaggaatataaaggtgtactatgagacttccacttttcaggtggaatatatgggtatcttagagtggtcta

SEQ ID NO: 26661 - DNA, 1826 bp, Homo sapiens
tttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgagttgatcgaatctacagatgcagaacccatggatacagagggccagcagtacactttgagaagtgtattcgaatccccggggacatgtcctttttaactgcattctcctccgccaaaaaagtgaccaagcagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacggagtctcgctctgtcgcccaggctggagtgcagtggcgcgatctcggctcactgcaagctccgcctcccgggttcatgccattctcctgcctcagcctcctgagtagctgggactacaggcgcccaccactaaacccggctaatttttttgtatttttagtagagacagagtttcaccatgttaatgaggatggtctccatctcctgacctcgtgattcgctcgtctcggcctcccaaagtgctgggattacaggcgtgagccaccgcgcccggccatgatttttcttcttttttaaggctgaataatatctcaatgtatgtatatataccactttttaaaaattcattcatctgttggacatttagattgttcccacctcttgg

SEQ ID NO: 26662 - DNA, 650 bp, Homo sapiens
ctttctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaa

SEQ ID NO: 26663 - DNA, 412 bp, Homo sapiens
ctcgccgaggcccctccttgcccgccgatatctctgccgggtgactagctgcttcctttctctctcggcgccgcgcggtgactccccaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacct

SEQ ID NO: 26664 - DNA, 340 bp, Homo sapiens
cgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccaggttgacaaggtcacaggcaggtttaatggccagtttaaaacttatgctatctgcggggccattcgtaggatgggtgagtcagatgattccattctccgattggccaaggcgatggcatcgtctcaaagaacttttgactggagagaatcacagatgtggaatatttgtcataaataaataatgaaaacct

SEQ ID NO: 26665 - DNA, 395 bp, Homo sapiens
cttgcccgccgatatctctgccgggtgactagctgcttcctttctctctcgcgcgcggtgtggtggcagcaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacct

SEQ ID NO: 26666 - DNA, 1002 bp, Homo sapiens
cggcgccgcgcggtgactccccaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggtgagctgggagcccgggaggcgggaaggttgtgatatatgtgcgggaaaggcaggctgtcccattgtggaggagcccctggggtgaaggtacaggcagaggctggctttgaggattggtgtttcccaaacctgggggagtggtttgtgacccttcttctctttctaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcactaggaggtgcccccccgaccccgctccaccatagtcaggctgcaggctgccccgggagaggtggctccccttctgcgcctgtctccattcgctcagcgggggagagacgtgggctggtggcacagctgaccttctgccatctcaggcagccggagtggaaatattcttagtgtgcttttttttttttcttaagggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaaccta

SEQ ID NO: 26667 - DNA, 494 bp, Homo sapiens
ctcgccgaggcccctccttgcccgccgatatctctgccgggtgactagctgcttcctttctctctcggcgccgcgcggtgactccccaggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatggtgagtgtttccctgggctttgctcatcacttcgggacatcgtggactttaccgtgcgcattggagtgtgtgatggtgcctgagtagatctgctggcagagtagtttgagccagctggactgggctggccgcctgccgcttcttgagggtggaagaggggtgctctgagaagacactcaggcagcagactctgcctctcac

SEQ ID NO: 26668 - DNA, 418 bp, Homo sapiens
caggcgcagcccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttttgactggagagaatcacagatgtggaatatttgtcataaataaataatgaaaacct

SEQ ID NO: 26669 - DNA, 3437 bp, Homo sapiens
tcaaaagaaaaagggggaaaaaaaaccatgcaaattagatatctctgaatttcttgcaaattaaataagacgcagattctggctcaggaaagtgatgcaaacgcgtcgttttcaaaggagagaccccagcctcgggtcaggcgcggcgcagacagcggcgcggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccacgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgggatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtatcttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtaggatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttg

SEQ ID NO: 26670 - DNA, 514 bp, Homo sapiens
ctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaacttca

SEQ ID NO: 26671 - DNA, 510 bp, Homo sapiens
cttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttca

SEQ ID NO: 26672 - DNA, 557 bp, Homo sapiens
cttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagcagaaatgaagtgtctagcagtgagctggagattggatcacagccgaaggagtaaaggtgctgcaatgatgttagctgtggccactgtggatttttcgcaagaacattaataaactaaaaacttcatgtg

SEQ ID NO: 26673 - DNA, 656 bp, Homo sapiens
aggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagcagtgagctggagattggatcacagccgaaggagtaaaggtgctgcaatgatgttagctgtggccactgtggatttttcgcaagaacattaataaactaaaaacttcatgtgtctggttgtttg

SEQ ID NO: 26674 - DNA, 2814 bp, Homo sapiens
aggcatcggcgcggtcagcctcgtggcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagatgagggaattggggcttggagtgcaagcattgggaagaatttcccaggaagagagatgcacagatgtgaagaactcgaaggcaagagaaagccggggggttgtgtggcaggtagaagtgccaggaccgtggagcgtgtggacatgtggcagattgcggaggggctgtggcaagtatttacaggtggccgttacctggaggaagactgaaaacagagaacagtgctgccaggcgtgccttttggagagggcactggtcagaaacggagccttcatgtcgcctgcctcacctgctcctgctggttctccccaccctgtggacggtgacttggtcctccacttgccagaagccttgtcagcaaccttgactctgtcaccccacatccaggccatcaacaagtcttttggccctttctttgaaatccaccaggaatccagctgcttctccccaccttcctgcctctctggtctgggccactaatgtcactgccatggccgccttgctgcatttctgaggatgcttcatctctccaccttcttctccactcagcagccagcagggcactgtggaaatcggagtcacatgagctggcacctctgttcagaaccctccagggctccacatctctctcacccaaatgccaaagacctccccacgcccccacaatcccccacgacctggccactggcctcccaccaccttccagctccagcggctcctaccacatttaaggctttccttcctagttttaatttttcctcgtcagcagttgattttattattttcttgtttattggtattttcccactagaaatgaagctgcgtgaagttagagatttttttttttggtctgtgttcctaattagctcattgctatacccctggcgcccagaacaatgccttggacacagtacgcagtagactaaataaatacttgttgaatgactgactgacggaatgacggctgtgtggggagtggattgggtcgtgaggcagaggctgcggtggaaactcaggcaggaggtgatggtggttcttggggctgcggaatgccaagtttagaagctcttcctctgctgtggcacatgaaccggtcactcgagaaggcttttagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggt

SEQ ID NO: 26675 - DNA, 835 bp, Homo sapiens
tcctcctcctcctcccgcgccccccgtgcagccacctgctgcacttgcgcactgggagcgacacgctcgggcataagtagtgccggaaagttagctgccgagacctggtggattgcttttcgtttatcagtgcaggaaaacagcgctatagtatgcgtcacaactagcgcagactccggcagtatttaggcggtgcggcttgggaactagaatccacttcctgtcttccgcctcaggctagagggcgagcgcttcgccgtgggacttcttctgcctggctccgccttttgccccggaagtactcacagcggacggtggtttttgggcccgtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaa

SEQ ID NO: 26676 - DNA, 840 bp, Homo sapiens
ctgcatcgtccagaattgcttccgagtcggcgcggcgcaaggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaatattgcatgttaagtgtatctgtgccagataaggtggggattttgtgtgttagaccaagtgtgaagtgacacacattattttcatggggaagaaagcttattcatgtaa

SEQ ID NO: 26677 - DNA, 623 bp, Homo sapiens
ggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaa

SEQ ID NO: 26678 - DNA, 350 bp, Homo sapiens
gctcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaa

SEQ ID NO: 26679 - DNA, 625 bp, Homo sapiens
cctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactcttaaaatttgaatgtatgagactggcaaagttttgcatcttaggaggagtgattcatttcaccgtgatctctcatcacatttcacatacaacccctacgtttttttgtgttgggaaacaatgtaatggatgatgagttgggcataagtgcaggaaagacgggtgtaatagaggaaaaaaatgttatctgcttttctttcaggatgctataaaatcaccacggtctttagccatgcacaaacggtagttttgtgtgttggctgctccactgtcctctgccagcctacaggaggaaaagcaaggcttacagaaggtaaatggtttactaatgtgat

SEQ ID NO: 26680 - DNA, 1344 bp, Homo sapiens
ccgggggctgagcggcccgccgggttccggggtggcgccggccccggtggccgcgggcgctccctcgccatggcctaagcccgaggccgctccccagccagattctggcctcaggcactgcagagcccgcggcgctcgccaacaagcccgttagacccacgggacttggcaccctggaacgctcaccatccccgggtcttccctgcgccctggacccgagtaccctgctgcggcgtccccctaccaccgagaggagggcctagagcagacaagcccgccccgccgctcctcccagcagcttctatcccggaagttgatgccgagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaatcccctctttttctttttttaaaatatatttgagtatgccatacatttatatatatggtgtatatgaatttggtttaaacattttaaaatttattctgattagtttgtgtctttttttttttttttgagagagagagtcctgctctgtcactcaagctggagtgcagtggtgcgatctcggctcactgcaacctccgcctcccaggtccaagcaattctcttgccttgtcctcccaagtagctgggattataggcacacaccaccatgcctggctaatttgtgtctcattttcaagagtagaaaccctaaatattttattttcattccttttccaaattgctatgaatgggattaaaggattacagatgtaaagtctattatttgtgaattctaaatgtagttctgctgttgtacctgtggaaacatcttaaagaagtacatattttgcacgtcctgcacgtgtaccccagaacttaaactataattaaaaagaatagtttcaaaaaaataca

SEQ ID NO: 26681 - DNA, 528 bp, Homo sapiens
agaacaaagcaaacctaaggcacagccataccccgcagaaaacttcgaaatctgcgccttgaaaagggaagccaaaaggatacgagcctctttcataatctctctgttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatg

SEQ ID NO: 26682 - DNA, 923 bp, Homo sapiens
aggttgcgcagcgtcttcgcgcgtggcgggcatgtagtgacttgcccggtcaccgcggcgcggctggccctgcaggggcgtgggctgcaattcagaggcggtggctgggaggggaacagttctctgtgtagcttatgagcggtcttggtctttgaggatgcccctgaggttgtgatctttgggtcttttggctttcccagtgattggtgtttctcgccccctctgccttctttcggaagcgatttcctacttgttttccttttttaaaaactgtcctcgttgttgccttatatattaattccgtcaaggacggtcgctcagcaagaattcctgtcagatcagctgttgagccacaggagcaaaaatcacccaggcgctgacgttgtctggtctacttcagcagtttctactctaagcgagtccacagtcggggtcactttctttgcttagcacctcgacttcgcgcagttttcatcgaagacagttcattacgcattggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 26683 - DNA, 681 bp, Homo sapiens
aggacaaagtttgccttaccatatgtttcctgatcgtgcgaaagcccttttctagggacttggagaacacaagtattatgaaaagtactgatgaaagttattaacaggtttcgaaaaataactttactatctgacgtgttgcttctgccgaggatgaccgttattcctgtttttgcatgtatatttcacgtatggttaaatgtgccagcgttgtggtttaaaactaatagtaataatatgcttctttgttcagttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattccataattctaattaatttaccaagataatgtaattacatttggttttgtaaggtatacagcagtaatctcctattttggtgtcagtttttcaataaagttttgattatgggcaaa

SEQ ID NO: 26684 - DNA, 380 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagtt

SEQ ID NO: 26685 - DNA, 1160 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtaatcgggtgggggcatttggccgactgccggcgacctaaaccctgatgtgacctctaccctgccctaacccctgccagccggaatccgggagccgattctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctg

SEQ ID NO: 26686 - DNA, 1288 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtcaccgcattctccttcaccaggtgtggctgtctgggagccagggggtgactcgctctggagagaggggaaaagaggggggcctgctgcaatctccttgaggcaggaaacgtgggattcagccccagcctcacttagtggaggttcttttaccatggacccaggctgcctggtttgtatccaacctctgccccttctgacctggaagaggcgcttgaccttcctcccacatcccttccagtggggtgagtacaggtgttcctcagtttacaatgggttacattccggtgagtacatcataggttgaaagtattgcaagttgaaatgtgtttaatacacctaatctcccaaacatcacagcttagcatggtccatcttaagcttgttcagaacgccttagcctgtagttggggaaactcgtctaacacgaagcctgt

SEQ ID NO: 26687 - DNA, 296 bp, Homo sapiens
cttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacccttca

SEQ ID NO: 26688 - DNA, 1374 bp, Homo sapiens
cttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagaaagacctgagctgtcttccttggcactgcctatggaggtgacacccatctcctccatcatggccatcctgagaccgctcgcgaagcccaagatcatcaaaaagagcaccaagttcactgggaaccagtcagactgatatgtcaaaattaagggtaactggtggaaacacagaggtattaacaacagggttcatagaaggtttgagggccagatctatgcccaacattggttatgggagaaacaaaaagacaaagcacatactgcccagtggcttctggaagttcctggtccacaacgttaaggagctggaagtactgctggtgagcaacaaatcttactgtgttgagatcactcatgatgtttcttccaagaactgcaaagccatcttggaaagagcagcccaggtggtcatcagagtcaccaatgccaatgccagcctgcacagtgcagaaagtgaatagacagtgaatgtgtttgttttattggggtttaaataaaaccaataaaactgtaaaaacaaaaacaacaaaaaccagagaccctggcttttggacagttgttcgtgtggctaatgcccccaacagttttattttttaaaattttatttatgtattgtttttgagatgaagtcttcctctgactggagtgcagtgatgcaagctcagctctctgcaacttccacctcccaggttcaagtgattcttctgtctcagcctcccaagtggctgggattacaggtgcccactaccacacctgactaatttttgtatttttgtagagatggggtttcatcctcttggccaggctggtttcgaactcctgacctcaagggatcctcccacctcagcttcccaaagtgctgggatcacaggcttgtattagttcattttcacactgctgataaagacatacctaagactgggaagaaaaataggtttattggactcacagttccatgtggctggggatgcctcacaattatggtagaaggcaaaaggcacttcttagatggcagcggcaagcaggaaatgaggaagacatgaaagcagatatcccttataaaaccatcagttctcgtgatacttactcactaccatgagaaagtatgggggaaaccgctcccatgattcagttatctcccaccgggtccctctcacaacatgtggggattatgcgagtac

SEQ ID NO: 26689 - DNA, 907 bp, Homo sapiens
gcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagttgaaaataatggtgatggtaacaggatatcccttgcttcctttaaagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagtttcttacttttgtgctttatttggtttcagggtctccttggcagctgtattctggagtctggatgttgctctctaaagacctttaataaaattttgtacaaagac

SEQ ID NO: 26690 - DNA, 866 bp, Homo sapiens
gcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacaggtatgtctgcaagggcaggggcctcttggggcataatagggtccttccgagtctttctgttaatacttgtatcccacattctggtaagcgtttggtgaataaaaatttcatttatttgctttatgt

SEQ ID NO: 26691 - DNA, 1306 bp, Homo sapiens
cggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagcctcttccatgagtggggagcccgctgcttgtctccagctcctagcagtgagtcctgataatctcaaatttaaggacagtaactttgtctgggatgagtgtgggaaaggatgtgtttgggaacagacgcgagcctgcagaggtgtttgtaaccatctctttctaagtggtgggaagcagacattttattctttaactgttaatatatatagtgtgtgttttttatgcatgaaatattttatagtttttaaaaatgcccacactactattttgaaagtaaatgaggtaatgtatgtgtcagaacccaatacccaaagcgatcgtagtaagaggtggggcctttgggaaggcattaaattgcttagggaatgagggtggaaccctcatgaatgagattagagccttataggagaggttggagggagttgcctggcctccctctcccatgtgaagactcagcaagaaaacattatttaggaagcagagagccctcatcaaacaccagatctgctggccacctgatctggcactttccagccttcagaactgtgagaa

SEQ ID NO: 26692 - DNA, 2097 bp, Homo sapiens
cctttatactcacttccgcccgcgagccacttcctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattcgttgtcctgtagttcaggattgtaggtttagaagagggatatgtttgagtttttcctatgcataaggcgatccacgttgcacatagaaagtgaatataaatggccattatattttgtgtcatgctgtgctctaagtgttctttacatatgtactcgttaatcaacctctctaaagtgtaaaggaaatttgcttgcaccactgaaggcacataaggctcagaagtaaatttgcctaagcagtataaagctatcattagaatccacattcctaagttgtgttctcttaggggatcatggaaccagtcattggtactacaggctattatgttctggagaactgtgaagaacatttaaattgtctctgattttatctatcaatgttttgaagtattttctaccagtgtctgtacttcacaagaaattcggcactattttttcaggcaaaactagtgagggacaggttggcttgaaaatcatgagactgttgttaaatcagatgctggttgatcacagaggggacttccagggaaagctgttatcaggtggctgcttcctggtgatgcagcctggctgatgagataaccctggctccacagatggcttagcaggtgctgtgatgatttggttttcttctcaattagactgagctgcacatggtgtttatattgcttggcacatggtaagggcttaatatttgaggtaattatgtagggcgtacactgacaagtatctgacccccccttcctttttgactcataaattggtcatcttaaccatttaagtgtacacttctatagtgacagagttagccctctgtccaagggatttgcatctgtggattcaaccaactttgggtcaaaaataatcaaaaaggatggttgtgtgtgtattgaacatgtagacttatttttcttattttcaaaatactatattttcttgtcacttattttcttgtacactgcagttgtaacagctatgtagcatgtacattaggtattaaaagtaatccagtgaagattgaaagtctaa

SEQ ID NO: 26693 - DNA, 934 bp, Homo sapiens
tagacggcgcgccccgcccccgtacgcctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaa

SEQ ID NO: 26694 - DNA, 1386 bp, Homo sapiens
ccttttggctctctgaccagcaccatggcggttgccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgtaagtgtttctttgcttcctcacacaacacaaccttgagtattggattattcctgagatgagagaacgcatatgagacaaggtaaaggtctgttgaaatcctgtctgtgaatccttctagctatatctctttaagtgaaagagtgttaagtactcagtaaatatgattattattactattattatttgagtcagagtcttgctctgttgcccaggctcgagtgcagtattgtgatcctccttggctcactgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctaaatgataacagttttttcgtgtttatttattttgaatgaagctgtctcacagtagatggagttgaaggacaggaaatgtttttcccctacttggaaaatacactgaataagttgagtggggtgggatgtgcctggagtcccagctactcaggaggctgaggtggtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaaga

SEQ ID NO: 26695 - DNA, 862 bp, Homo sapiens
cgccttacgaaaggcggcaaaaagggagccaagaagaaagttgaaaaatacagtaagaattgatctgcaatggaacttaagcatcttcttaaaatccagggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaa

SEQ ID NO: 26696 - DNA, 576 bp, Homo sapiens
tccgcccttttggctctctgaccagcaccatggcggttggcaagaacaagcgccttacgaaaggcggcaaaaagggagccaagaagaaagtacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 26697 - DNA, 985 bp, Homo sapiens
ccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcggggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 26698 - DNA, 671 bp, Homo sapiens
aagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaaacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 26699 - DNA, 1526 bp, Homo sapiens
ggctgagctgggcggagcagctgaaaatccggcgcgcgcagtctccagccccaatttctacgcgcaccggaagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattaatagcattttggttttgtgggttgtttttttttttaattcagtttcctgctattttactgtataacatgaacagtgattaagttctcaggcaggcttaggcagtctgttattggctgggcttagttagtggtgggaagtagaagataccagacttgggaaaggaacagcaactaaccaaggagtagaaagagccaagaaatcccggagtatttatctcccccgccttgacttggccaagaacttctctacacagtggacccctctgccctgttaagttcccttggctttctaaaaatctgccctcattttcttctccagtctgtattgcactagcccatccacaagcctggctcatctgtttttcccactcctgtgcccatcttgccaaacgcaggatgaaaatctccagttgccattaaaggtggtcataaatgggctgttgatgttgcaaagcattgcagttccttggacttagtgcccttattctccagctgccgctgcagtcctcaactctgtttttcagaggacagagatgtagaacataaacttgttcttgcttgtccaaa

SEQ ID NO: 26700 - DNA, 594 bp, Homo sapiens
aatttctacgcgcaccggaagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagccttgttaacagcagactggagggcacgtccagtgggatctgtgattatttgatttacttcaaggatatcagggagtagagatccaaaattgaaatgctatgtgaagtatttgttgattggatgaactggtaatgtaattgctgtttgtgagacaaaactcagtcgtgatgtacagggagc

SEQ ID NO: 26701 - DNA, 993 bp, Homo sapiens
ttccaggatatgaactctacagcggaagaataagaaaccggaactaaacttctcactcatctgacttcctgcggtttacgacaacagactttggttgcaccggaaaagaacagattctcttccgtcgcagagtttcgccatggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgtttcttaa

SEQ ID NO: 26702 - DNA, 811 bp, Homo sapiens
gcactgtggacgctctcttgacggatgctagggagacccgccaagttttcaaaggcccggggccccaagaagcacttaaagcgtgttgcagcgccgaagcattggatgcttgacaaactaacgggtgtatttgcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatggatgtcatcagcatcgagaagacaggtgaacatttccgcctggtctatgacaccaagggccgttttgctgttcaccgcatcacagtggaagaggcaaagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatggcaataaaccttggatttccctgcccaggggaaagggcattcgacttactgttgctgaagagagagata

SEQ ID NO: 26703 - DNA, 792 bp, Homo sapiens
atggcccggggccccaagaagcacttgaagcgtgttgcagcgccgaagcattggatgctggataaactaactggtgtatttgcacctcgtccatcgacaggtcctcacaagctgagggaatgtcttcccctgatagtcttcctcaggaatagactcaagtatgcattgactggagatgaggtaaagaagatatgtatgcaacacttcctcaaaattgatggcaaggttcgagtggacatcacataccctgctggattcatagatgtcatcagcattgagaaaacaggtgagcatttccgcctggtctataataccaagggctgttttgctgttcatcgtatcacagtggaagaggcaaagtacaagttgtgcaaagtgaggaagattactgtggggacaaagggaattccacacctggtgactcatgatgctcgaaccattcgctacccagatcctctcatcaaggtgaacgatactgtgcagattgatttagggactgggaagataaccagctttatcaaatttgacacaggcaatgtatgtatggtgattgctggagctaacctcggtcgtgttggtgtgatcacaaacagggaaagacatcctggttcttgcgatgtggtacatgtgaaggatgccaacggcaacagctttgccacaaggatttccaacatttttgtcattggcaatggtaataaaccttggatttccctgcccaggggaaagggcatccgacttactattgctgaagagagagacaagaggctggctgccaaacagagcagtggctaa

SEQ ID NO: 26704 - DNA, 740 bp, Homo sapiens
ctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagcc

SEQ ID NO: 26705 - DNA, 1203 bp, Homo sapiens
gggctgcaacccctcgcgcgggctccccggccgtggaggacacaaggacaaacacgaagggtccccgacctgccgaccccctcctcccggacaccgcgcgtagcctgtaggctacctccgcgctccacccagagacgggtcgcgctgctcccgccgccgcaaccccgggccctcgtgccggcggtctcccctcttccacgggcgagattactgcatagcagaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgagaaccctctgcaggtcctggtgaacgccatcatcaacagtggtccccgggaggactccacacgcattgggcgcgccgggactgtgagacgacaggctgtggatgtgtcccccctgcgccgtgtgaaccaggccatctggctgctgtgcacaggcgctcgtgaggctgccttccggaacattaagaccattgctgagtgcctggcagatgagctcatcaatgctgccaagggctcctcgaactcctatgccattaagaagaaggacgagctggagcgtgtggccaagtccaaccgctgattttcccagctgctgcccaataaacctgtctgccctttggggcagtcccagccacc

SEQ ID NO: 26706 - DNA, 863 bp, Homo sapiens
aagatgaaggtaggtgatggtggcgagtgttagactgggtttggggaacgtgaatcgagtcccagaacgcggcattgcctcagttccagcactccaggatcctggctttagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagatttttt

SEQ ID NO: 26707 - DNA, 892 bp, Homo sapiens
ctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaaggtaaaagttgacaaattgttgcaggtatttaagtcagagacggtaaacgccattggtaactggtatttggaatggggttcagactccgggttctggcttctgacctttggtaagttgcttccgaatgccactttataaagttagaggtattaccttggagggggggacgtagagtaagccataaaatatacgtaaagtttacatcaacataattcttgccctgcatcatgcatttggcaatatgtcacatagctgtcctcataatccccaaagtgccaaaaagggttgtatctgatttgtttgttgctgtttgatattttatcttcttagtgctgttatctctaataaaacatcggttagaaatgcgacttgaaagacatttgataattgaacttgacaagttgggaatatagacaaaactcactgaacagagaaaacgtgcttaagttcaaattggttttcataattatactttctcatataggtgtgttcacagaggtcacaatcctgtactgtataattttggaatagaaatagtaaatgtgtcattcattgtatgctcttgcagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaa

SEQ ID NO: 26708 - DNA, 1355 bp, Homo sapiens
gctgcttcaagatgaaggtaggtgatggtggcgagtgttagactgggtttggggaacgtgaatcgagtcccagaacgcggcattgcctcagttccagcactccaggatcctggctttaggtggagaagggtctcaagtaggagaaggctcgcctttctggggcatggagctttttggccgaacggatggcaggcgattgcggctggagccgcggcgggccgggagcgccatggtggcgtccccgcgcccagccgggacggatgcggcgtgttgcccagtttgcggcaggcctgtggtgcggctcttgaccccggctttcttgcttcgggagggtgaacggctgcggagtgccctcgcccccagagtcattccgcggggcttgaggggaaaacgtcctgctgagtgcggcgcttcttgactgctactctgctttcacgtgcttttagtgagtacagtcggcatcttatatttcctgcttgtgtggaggcaacatgaaaggctttttgcagtggaattaactttgtagatggctctacaattacctgtatagatagtttcgtaaactatttccccccttttaatccttagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaat

SEQ ID NO: 26709 - DNA, 1387 bp, Homo sapiens
gctaagcggaagttggccctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtcagaaataagattttttgagtaacaaataaataagatcagactctgatctctgttgacttttcattgctgatagaaaactacataaatgaagagagggaaagttaggtcatagaaaatggggatatgtatatatggtattccaatggtggataaagtcagacctattgtgtgtggtagtggaagacaaggtcagtgtacaggggttcctttcaggggatgggtggcacaggaagggattctgagcataagacacctgcctcttcagaatggcatggaacttaggggaaatgatgaggactattaatcttttttatatagtttatttttgaggaatatagctctttaaagcactatacacaatttaatacatgaaaattgaccttgtgaagatgaacatgtcttttttaaaaggtaacttttaaggcatagttttagtggatacctagttttagtggataccatccactaaatggtttttaagccatttcaaatttgttttaacaaagcttttcaactccagtgaattgttaggctgttcacacactgaaaaggaaatgactaaaaacattcttggatcagtgaaaaa

SEQ ID NO: 26710 - DNA, 786 bp, Homo sapiens
gggactctctagcctcctaccgcttctcagtgatgttccggtttccgccctcctcctcgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 26711 - DNA, 764 bp, Homo sapiens
ctcttcctaagccggcgctcggcaaggtaggttggcggcctgctctccgacagaacttttcttcttgggttgaggaaaacgccttttggagtcaggccctggaggggcgagccttgctcacaggttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagta

SEQ ID NO: 26712 - DNA, 704 bp, Homo sapiens
ggcggcctgctctccgacagaacttttcttcttgggttgaggaaaacgccttttggagtcaggccctggaggggcgagccttgctcacagggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaaacaaaaatgactaaataaa

SEQ ID NO: 26713 - DNA, 685 bp, Homo sapiens
tctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgcttta

SEQ ID NO: 26714 - DNA, 881 bp, Homo sapiens
ctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaaggaaaaagaatgccaaaatcagcagtctcctggaggagcagttccagcagggcaagcttcttgcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgcttta

SEQ ID NO: 26715 - DNA, 829 bp, Homo sapiens
tccactgcttctcagccagccaacgcctcttctgattggctctgacgtgcgtggtgcgtgaaaacgtcacgagacgccggcgttactataagagcgcagccgtggcgcttgcgcgcctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 26716 - DNA, 772 bp, Homo sapiens
ccgggtggtttgcttaggtgaggtgcggcggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 26717 - DNA, 709 bp, Homo sapiens
ttacgctcacacttctctcccgcgcaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 26718 - DNA, 1617 bp, Homo sapiens
ccgggtggtttgcttaggtgaggtgcggcggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 26719 - DNA, 752 bp, Homo sapiens
accgggtggtttgcttaggtgaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatg

SEQ ID NO: 26720 - DNA, 1600 bp, Homo sapiens
gcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcaggtaccacctcggatgggcacctgaatcttcctccacctgcccctctgatggttgccctcactaagcctgctgtccctatctcctatgcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacaggtaacagctcttggtgtccccagtggagggagagaaccagcctcacctcgcttgggtggtgggttcagctgtctcctggctcgcttgtgaagttgattccagaccccgatccatgactgcgttctgggtactcagtgtgccctttctgtaatgtggcaccattgagggggaggagctgtacagaaagagggcaagatgtttgcgtttagaatcttcgccccagcccttcactaaccctgtgagccgtaggcagagccttgtgtgtcaatgctttcgtcggagacgtagcctcgggttgctgtgttattgtgggcattgctgctgcacgtggtaatacagctcagtgtcaggtgtggggttcacgatatttcagactcggaacttgggggctctcacatggccatctcatttgctttgtggtcttaggtgggatactttcagatttctcctataaaatggggttgagaaagtcatctgaagcatttttggggattaaggtgataccctaaaaccccggagggcgcacgtaggatcaggtgcacccttcctgcagcgccttggtgtctgcagccgtggcggcctcacggggtgggtggagaggaaagagtggtgcggtagctggggttagcgtccgtttctcctccagtccacctcaccttgtcgcttcttccagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaaca

SEQ ID NO: 26721 - DNA, 944 bp, Homo sapiens
ccgggtggtttgcttaggtgaggtgcggcggtgtgctttttctctagggtttgggttggatggtggcccgggccttccgagtttccatgagcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagccctcggaggtgatgggtgtgaactcacccagagggtacagattcacccttgcacacagctcaccagggagctggggcagcctcttgccccaatagcccagcgcaagggtcactgcggctctagccgtacaccttgtgaaggcctctgccaggcatgtgggcagctggacagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaa

SEQ ID NO: 26722 - DNA, 1257 bp, Homo sapiens
gtctgacgggcgatggcgcagccaatagacaggagcgctatccgcggtttctgattggctactttgttcgcattataaaaggcacgcgcgggcgcgaggcccttctctcgccaggcgtcctcgtggaaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 26723 - DNA, 912 bp, Homo sapiens
ctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaa

SEQ ID NO: 26724 - DNA, 1218 bp, Homo sapiens
gtctgacgggcgatggcgcagccaatagacaggagcgctatccgcggtttctgattggctactttgttcgcattataaaaggcacgcgcgggcgcgaggcccttctctcgccaggcgtcctcgtggaagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtctctggactcttaa

SEQ ID NO: 26725 - DNA, 1344 bp, Homo sapiens
aggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccctgtctctcctcagtgacatcgtctttaaaccctgcgtggcaatccctgacgcaccgccgtgatgcccagggaagacagggcgacctggaagtccaactacttccttaagatcatccaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaaactgctgcctcatatccgggggaatgtgggctttgtgttcaccaaggaggacctcactgagatcagggacatgttgctggccaataaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctgagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtaccccattctatcatcaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctttaaaaagtc

SEQ ID NO: 26726 - DNA, 919 bp, Homo sapiens
tggacacataagaggctgcgtataggcgcgagagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaat

SEQ ID NO: 26727 - DNA, 445 bp, Homo sapiens
agagcccctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttac

SEQ ID NO: 26728 - DNA, 5088 bp, Homo sapiens
cgccgccgccttctgtgcagtcgcggcccgggcggacggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctgaaaatctggaaggggctcttctactgcatgtgggtgcaggatgaaccccttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcgaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccatccctggaacagaaccggggcagggagcccgaggcctctgggctgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttctgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggcttaatggctgcattagataggatcctcacatcccattcagaaccaaaactgatacagtgaaacaattaaggtgagcaaatagttttaacttttcttttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaagtctttgccctcc

SEQ ID NO: 26729 - DNA, 1159 bp, Homo sapiens
ctgccagctgatgccgggagctaactaccgcgccggggccggggccggggccggggcccgacgtccccgcggggcccgggaccgcgaggaggacggcgggggcctggagcccgcggccgtggcccgcgacctattgaggggcacatctaacatgtcatttgaggagctgttggaattgcagagccaagtggggactaagacgtacaaacaattggtagctggaaatagtcctaagaaacaagcttctagaccacctatccaaaatgcatgtgttgcagataagcacaggcctctggaaatgtcagccaagatccgagtaccatttttacgtcaggttgttcccattagtaaaaaggtagcccgggaccctcgctttgatgatctgtcaggggaatataatcctgaggtgtttgacaaaacataccaattcttgaatgacatccgagcgaaagagaaagagcttgtgaaaaaacagttgaagaagcacctttcaggagaggagcatgagaaactgcagcaactgcttcagcgaatggagcagcaagaaatggcacagcaggaacgaaagcaacagcaggagctgcacctggccctgaagcaagaacgtcgggctcaggcccagcagggccatcggccatacttcctgaaaaaatctgagcagcgccagttggcactagctgagaagttcaaggagctgaaacgcagcaagaaattggagaacttcttgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatccctagggctacacaagaatagttcagccttctgccatgccacacagcctcagcttgaatctggttcattgcgtcctcgtgttcttctctcatccttgccttaaaccagggattctgataccgaagaagaggggccaatgaaaaccatggagtctgttcgtgactcccagggctgggacattatgtaggagccacttcataaacattctctttactca

SEQ ID NO: 26730 - DNA, 4737 bp, Homo sapiens
atggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaaggccgagggggcccagaatcagggcaagaaggccgagggggcccagaatcagggcaagaaggctgagggggctcagaaccagggcaaaaagtccgagggggctcagaaccagggcaaaaaagtagaaggggcccagaaccagggcaagaaggctgagggtgcccagaaccagggcaaaaaggccgagggggcccagaatcagggcaaaaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 26731 - DNA, 3727 bp, Homo sapiens
gaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 26732 - DNA, 3792 bp, Homo sapiens
cggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggagggcagaaatacagatgtggcccagagcccagaggcaccaaagcaagaggctcctgccaagaagaagtctggttcaaagaaaaaagggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 26733 - DNA, 5041 bp, Homo sapiens
cacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcagaaagaagcttccggttctgaggtcctggaggtgccatttccctctctgttgaagcaaaggccggggcagacctcctagtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaaggtagaaggggcccagaaccagggcaaaaaggcagagggggcccagaatcagggcaaaaagggagagggggcccagaaccagggcaagaaggccgagggggcccagaatcagggcaagaaggccgagggggcccagaatcagggcaagaaggccgagggggcccagaatcagggcaagaaggccgagggggcccagaatcagggcaagaaggctgagggggctcagaaccagggcaaaaagtccgagggggctcagaaccagggcaaaaaagtagaaggggcccagaaccagggcaagaaggctgagggtgcccagaaccagggcaaaaaggccgagggggcccagaatcagggcaaaaaggccgagggggcccagaaccagggcaagaaggccgagggggcccagaaccagggcaagaaggccgagggggcccagaaccagggcaagaaggccgagggggcccagaaccagggcaagaaggccgagggtgctcagaaccagggcaaaaaagtagaaggggcccagaaccagggcaagaaggctgagggggcccagaaccagggcaagaaggccgagggggctcagaaccagggcaaaaaggccgagggagcccagaaccagggccaaaaaggagagggagcccagaatcagggtaaaaagacagaaggggctcagggcaaaaaggcagaaaggagtcccaaccaaggcaaaaaaggagagggagctcccatccagggcaaaaaggcagattcggttgctaatcagggcacaaaggtagagggtattacaaaccaggggaaaaaagcagaagggtcccccagtgaaggcaaaaaggcagaagggtcccccaaccaaggcaaaaaggcagacgcagctgccaatcagggtaaaaagacagagtcagcttctgtccagggcagaaatacagatgtggcccagagcccagaggcaccaaagcaagaggctcctgccaagaagaagtctggttcaaagaaaaaaggtgagcctgggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtagctccgagagaagccatgagagacaagtctcttagagccacagaagtagaccttccagagccccagtttgtaaatgaacctgtgtcacatttgataaacactatcctgggcgcagccccgggccaccgccgagtgacgccaaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtgtgacctcctgggtgttgatgccattaaaaccaacgttggtgcccggtg

SEQ ID NO: 26734 - DNA, 1191 bp, Homo sapiens
gaaggcaggaggcggcgatcccggcggagggggccgttcgccagctctgaggcagaaagtgccacgactccacacgcgcgcacgcagccagcgagcggccggagcggacggcagacggggcgggcggcgtcagggtcgcagcgtctacagctgctcgggggcggtttcttggcggaggcttggccggctcctctctcccggctccgcggcggctgcgaaggcggcggctcctgccctctcgctttccctctcgcgtctctggctgcaggtgaaaggaaagcaagccaggatggatatttacgacactcaaaccttgggggttgtggtctttggaggattcatggttgtttctgccattggcatcttcctggtgtcgactttctccatgaaggaaacgtcatatgaagaagccctagccaaccagcgcaaggagatggcgaaaactcaccaccagaaagtcgagaagaaaaagaaggagaaaacagtggagaagaaaggaaagaccaagaaaaaggaagagaaacctaatgggaagatacctgatcatgatccagcccccaatgtgactgtcctccttcgagaaccagtgcgggctcctgctgtggctgtggctccaaccccagtgcagccccccattatcgttgctcctgtcgccacagttccagccatgccccaggagaagctggcctcctcccccaaggacaaaaagaagaaggagaaaaaagtggcaaaagtggaaccagctgtcagctctgtagtgaattccatccaggttctcacttcgaaggctgccatcttggaaactgctcccaaggaggtgccgatggtggtggtgcccccagtgggtgccaagggcaacacaccagccactggcactactcagggcaaaaaggcggaggggactcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaaa

SEQ ID NO: 26735 - DNA, 2485 bp, Homo sapiens
ctctcgctttccctctcgcgtctctggctgcagaaagaagcttccggttctgaggtcctggaggtgccatttccctctctgttgaagcaaaggccggggcagacctcctaggcccccagatgccgacggccctctctacctcccctacaagacgctggtctccacggttgggagcatggtgttcaacgagggcgaggcccagcggctcatcgagatcctgtctgagaaggctggcatcattcaggacacctggcacaaggccactcagaagggtgaccctgtggcgattctgaaacgccagctggaagagaaggaaaaactgctggccacagaacaggaagatgcggctgtcgccaagagcaaactgagggagctcaacaaggagatggcagcagaaaaggccaaagcagcagccggggaggccaaagtgaaaaagcagctggtggcccgggagcaggagatcacggctgtgcaggcacgcatgcaggccagctaccgggagcacgtgaaggaggtgcagcagctgcagggcaagatccggactcttcaggagcagctggagaatggccccaacacgcagctggcccgcctgcagcaggagaactccatcctgcgggatgccttgaaccaggccacgagccaggtggagagcaagcagaacgcagagctggccaagcttcggcaggagctcagcaaggtcagcaaagagctggtggagaagtcagaggctgtgcggcaagatgagcagcagcggaaagctctggaagccaaggcagctgccttcgagaagcaggtcctgcagctgcaggcgtcccacagggagagtgaggaggccctgcagaagcgcctggacgaggtcagccgggagctgtgccacacgcagagcagccacgccagcctccgggcggatgccgagaaggcccaggagcaacagcagcagatggccgagctgcacagcaagttacagtcctccgaggcggaggtgcgcagcaaatgcgaggagctgagtggcctccacgggcagctccaggaggccagggcggagaactcccagctcacagagagaatccgttccattgaggccctgctggaggcgggccaggcgcgggatgcccaggacgtccaggccagccaggcggaggctgaccagcagcagactcgcctcaaggagctggagtcccaggtgtcgggtctggagaaggaggccatcgagctcagggaggccgtcgagcagcagaaagtgaagaacaatgacctccgggagaagaactggaaggccatggaggcactggccacggccgagcaggcctgcaaggagaagctgctctccctgacccaggccaaggaggaatcggagaagcagctctgtctgattgaggcgcagaccatggaggccctgctggctctgctcccagaactctctgtcttggcacaacagaattacaccgagtggctgcaggatctcaaagagaaaggccccacgctgctgaagcacccgccagctcccgcggagccctcctcggacctggcctccaagttgagggaggccgaggagacgcagagcacactgcaggccgagtgtgaccagtaccgcagcatcctggcggagacggagggcatgctcagagacctgcagaagagcgtggaggaggaggagcaggtgtggagggccaaggtgggcgccgcagaggaggagctccagaagtcccgggtcacagtgaagcatctcgaagagattgtagagaagctaaaaggagaacttgaaagttcggaccaggtgagggagcacacgtcgcatttggaggcagagctggaaaagcacatggcggccgccagcgccgagtgccagaactacgccaaggaggtggcagggctgaggcaacttctcctagaatctcaatctcagctcgatgccgccaagagcgaagcccagaaacagagcgatgagcttgccctggtcaggcagcagttgagtgaaatgaagagccacgtagaggatggtgacatagctggggccccagcttcctccccagaggcgcccccagccgagcaggaccccgttcagctgaagacgcagctggagtggacagaagccatcctggaggatgagcagacacagcggcagaagctcacggccgagtttgaggaggctcagacctcggcatgtcggttacaagaagaattggagaagctccgcacagccggccccctagagtcttcagaaacagaggaggcctcacagctgaaggagagactagaaaaagagaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgtctgagtttcctctttggaaaaagaagttactgttcaacttaccaaaatgccttacaca

SEQ ID NO: 26736 - DNA, 2415 bp, Homo sapiens
atggcgtcgggctgcaagattggcccgtccatcctcaacagcgacctggccaatttaggggccgagtgcctccggatgctagactctggggccgattatctgcacctggacgtaatggacgggtacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttcttt

SEQ ID NO: 26737 - DNA, 2569 bp, Homo sapiens
acggagaaggggcggggccaaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaa

SEQ ID NO: 26738 - DNA, 2511 bp, Homo sapiens
actcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcaccctgctcttcagggaggtcagttttttacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaatagacttcttgaggctactataagttttgagaaataaggttcaaaaaataagaatgctaacacttaagcacagactagagcttgcttgggtttcttcctgcattacaaggtaaaaatttgttaatgtttgtttttattcagcttgggaaagctttgtgccatgaatacgtcgcatttaataacaagcaacacacggcatatagaaataactttaattaaaaaacttacatagaagattataatatcagacgtgacaaagatttgagtttatttgcctggacaacttgggtttgtctggcttttgttttctttttctttaaaaataaatgtacagtaaaactacaagcaaaa

SEQ ID NO: 26739 - DNA, 1128 bp, Homo sapiens
aaaactgcgcgcccaatcggggtgacgctctagccttgccggggactcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaagg

SEQ ID NO: 26740 - DNA, 546 bp, Homo sapiens
gggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcaccctgctcttcagggaggtcagttttttgcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaac

SEQ ID NO: 26741 - DNA, 2130 bp, Homo sapiens
actcgtgggtaacttgcttttgggagccagcggtatggcgtcgggctgcaagattggcccgtccatcctcaacagcgacctggccaatttaggggccgagtgcctccggatgctagactctggggccgattatctgcacctggacgtaatggacggacatgcacatgatggtgtccaagccagaacagtgggtaaagccaatggctgtagcaggagccaatcagtacacctttcatctcgaggctactgagaacccaggggctttgattaaagacattcgggagaatgggatgaagtcttgctctgtcacccaggctgaagtgcagtggcacagtcagggcccattgcaggttggccttgccatcaaaccaggaacctcagttgagtatttggcaccatgggctaatcagatagatatggccttggttatgacagtggaaccggggtttggagggcagaaattcatggaagatatgatgccaaaggttcactggttgaggacccagttcccatctttggatatagaggtcgatggtggagtaggtcctgacactgtccataaatgtgcagaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctgactgcccctttctagctggacctttaacaaatcacccaatcttttttgtgtttctctaaagtcatttatacattaaatgtaattatagcaactgtggggttctgttgagaattaagagctaacactatatatgtaaagtttccagtactagtcccagaatttagaatatgctcaacacaaagtaaacagcattatataagtttatatttttgtgagttataaagtactttgatatattctcattaaatctgtaaatcacctctataagtaagtggtaataataaagcagatatttttgtccccatttaaaaaatgaagaaattaatgcttaatagggtggtaccctggaaaggatctgggaagtggtagaatttctggtctgtacttttacaaatggagcccttgggaggtgggttaggtaaaagaagctttttacttaacgttgtcttatttccagtctaattttacgctgtagcagaaccagatggctgagaaaattctggaactatggatcttgaccccaaggatatattattttattccaagaaagatcaggtaggcgaaaagatgacaggatacagagtcaatccataaactaaatatttataactgttctgaattatacagagtctaaaaatatgtgtcagctacttcattcctgtaaatactcttgctgtgttataaatatggcaagaaataaacatgaccaatatcaat

SEQ ID NO: 26742 - DNA, 1343 bp, Homo sapiens
aacttgcttttgggagccagcggtatggcgtcgggctgcaagattggcccgtccatcctcaacagcgacctggccaatttaggggccgagtgcctccggatgctagactctggggccgattatctgcacctggacgtaatggacgggcattttgttcccaacatcacctttggtcaccctgtggtagaaagccttcgaaagcagctaggccaggaccctttctttgacatgcacatgatggtgtccaagccagaacagtgggtaaagccaatggctgtagcaggagccaatcagtacacctttcatctcgaggctactgagaacccaggggctttgattaaagacattcgggagaatgggatgaaggttggccttgccatcaaaccaggaacctcagttgagtatttggcaccatgggctaatcagatagatatggccttggttatgacagtggaaccggggtttggagggcagaaattcatggaagatatgatgccaaaggcaggagctaacatgattgtgtctggcagtgctattatgaggagtgaagaccccagatctgtgatcaatctattaagaaatgtttgctcagaagctgctcagaaacgttctcttgatcggtgaaaccataaggagcccagtgttcctgttcatgaaatctcccttttactggaaaacaggaatattgactaccaaatcacaatgcaattgaagccgtactgcttttttgagcagttattcattccagtgattaaaactgattgtgcagaatattctaagaggtcagaaattggtgtgtataactacatttttagtgatgcaatttattgattagtgagtaagatactgtttttattgagagatttgatttttataaagtaaaaatacggctgcattagggttacaaacagaaaagtgtcttaatgtctaaggagggcatattagctacactacaaaaacaaattttgtctgtacttctgaaaagaattttgttgtttctcagctgttttccaaaagcaaaggaagtctttatggtttttttctatttcatgttattgtgatttgtttataagtttgggtggggtgcataccatattcttggttcttaaaatctatcacttttcaccttacacttgatgtgtgaaaactataaaaacaatgtgtgaaacccaggggttctaaaatacaagcatagattttatcagggtgttttgtcaaagcaggttattcagtgattcctccccaccattcttaagaacgttaaataatgctgttgtgttagctctgagtagaaaggaaaaagtaaaacctctgtttggaggtaatattgggttgaattctga

SEQ ID NO: 26743 - DNA, 6321 bp, Homo sapiens
atgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaatgggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcacaccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagtttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggtttgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttat

SEQ ID NO: 26744 - DNA, 2375 bp, Homo sapiens
atgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagatggcgtct

SEQ ID NO: 26745 - DNA, 3868 bp, Homo sapiens
gtacactgcagttgtctccgaggtgaacctccggagccttggcacagctcgcttctaaagcttggaaatgacccgccacacctgaagcctgcaggtgctgaggccacattcgatcagacccaagctttgggagaccgctggggaaatttcccacttcctctcctgagaccaggaactcagcagagaaactttgtggaaaatgaactgaaggatgccacccagggagagtatctcctgagatcccatcatgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagcctcagaaaaccaacctccagtgtccgcactttaggaagtgtcccatgctttcacagttgacgatgacgttcgttagcactcttggtttcaagcgacagaaaacccaaacaggaaattgtttttgtgcccatcactgaaaatgtggcttcagacatggctagatccagggctcaaatctgctggcctcagacccagtagaatccaaggcctccccgacatcaccaggacttggctgctctctgccctcctctggatcagcttcagccttggtttccctgtggagacccccagccactccagccctgaccctcctggtggcaaagtggctgcagcctcacctcctcccaagccaaagtccaatagaaaggggcttccctctcccgcagcattctcaggcagaggcccattgccctccgtaggccccacaccacccaggtcaccagtcgctgagggttcagactgtgcttggcacaggggaggtccagaccccagccagtccagaggttcttcccaggagaggagctcctgacgctggaggaagaggcctgaggaacaggcctgttacccagaggatccgctatccaggaggctcaggttgaggctaagaaggagcatgaaggcgcagtgcggctgctagagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccacagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagatggtctcctaacagagctggaattagattgaaccgaggcctgaagaagacctgtttccacgcctttccccatgtgccacgttctcctcacctatccaggagtgaatcatcaccttccctgcaatctgctcagattacaaacccggaggaaaggctggagcacttgttctctgggtgaaggacccatacccccactggtttttgagatcggcattcagcgctgtcttatggcagccacagccccaggtggccccagagcccttgacatgtggccacctggggctgagtgtgactgaggccctgaatttttacttctataaaattagttccagattagtttacattctaattagtttacatgtaaacagccacacgtggctggtggccaccagtgctgacgcccagctctggatgaccacacctgctacaagagatgacttttctagagaagagtagaaacacagcggcagaaacacagctctgcacttccgagggcctcccactccttctgatgagactgcagaggaagtctgtttggccaagcatgctattaacacgttttcctgcttgttttgttttttaacagagcaaacaggtctgtttctattaaaattt

SEQ ID NO: 26746 - DNA, 5728 bp, Homo sapiens
gagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcgacagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagcggagaacaagcagctgcggcgtgcaggctgcccctaccaggcagacgagaaggtgaagcggctcaaggtaaagcgcgcggagctgaccgggctcgcgcggcgcctagctgaccgcgcccgcaagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcgcgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggagtggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggcgcgggtggaggtgcggctgccacgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccctattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctcccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgtggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggaacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatag

SEQ ID NO: 26747 - DNA, 5784 bp, Homo sapiens
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcgacagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagcggagaacaagcagctgcggcgtgcaggctgcccctaccaggcagacgagaaggtgaagcggctcaaggtaaagcgcgcggagctgaccgggctcgcgcggcgcctagctgaccgcgcccgcaagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcgcgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgaggatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggagtggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggcgcgggtggaggtgcggctgccacgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccctattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctcccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgtggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggaacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatctt

SEQ ID NO: 26748 - DNA, 5475 bp, Homo sapiens
cggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggaggtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctccctcaccactccatgtgcgtccctccagaagctgtgtgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatag

SEQ ID NO: 26749 - DNA, 5784 bp, Homo sapiens
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagtagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggaggtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatctt

SEQ ID NO: 26750 - DNA, 5475 bp, Homo sapiens
cggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcatcatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccgcaccactccatgtgcgtccctccagaagctgtgcgctcaatggaagaggatgaccatccccgatagaggacgatcggtcttcagtcaagagtataagagtagctgcgctcccctgctagaacctccaaacgagctctcagaatgttatttttctgtcttatgtccaacccctcattaaaatgttcatag

SEQ ID NO: 26751 - DNA, 5784 bp, Homo sapiens
ccagccacctgacccaaatacaccacctgaacccacgaccaggtatgcccacaccccatgggtggccttaacacacacaccctgcccctttctccaagtacaggagcagcagcccagacttccctcggggcaccgcggcctgcttgggactgcacagtgcctgggagggtgcctggggagggtcacaagggacttggtgctagaagcaggaaaagtgtagggaccggaaaagcccccgtgcatcctggaagggacatgggccagtttgagcaggggtgtgggagtccagccctggccttgccaggtggagaggcgcctgggccagacatccgcggcaggaggcgggggaacatgccaagaggcggaaggggcacgcggagacccccagggggcgccggaaggggcgcgccgggcggtcggcggcggccgttggcgagctgaggcctgccaggcgaagtctggagaccagccgggccgcggccgcaatggccaaggactcgcccagccccttgggcgcgtcgcccaagaagccgggctgctccagcccggcggcggcagtgctggagaaccagaggcgggagctggagaagctacgggcggagctggaggcggagcgggcaggctggcgggcggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcacgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggctggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggaatggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggtgcgggtggaggtgcggctgccatgggacttgctgcaggtgtattggggaactatgtcctccaccgtcaccttcgacacactcttggcaggacctccctacccaccgctggatgtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccgtattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctaccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgcggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcatcatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatctt

SEQ ID NO: 26752 - DNA, 10988 bp, Homo sapiens
caaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaaaaaaatatatatatatatatatatatatatatatatgtatgctttttcttttttttttggcttttgtttgctttttgacttttacttaaaacccttttacatttccactttaaatgcctattgtttattgggagaaggaaagaaacttttgtatgtctgacagagtcccaagatttttcatttctctgcataacagtaaaaggcaacattattggcctccaaccttctttttttttttttttttttttttttggagagggagtctgcttctgttgcccaggctggagtgcagtgggttgatctcggctcgctacaacctccacctcccgggttcaagcgattctcctgcctcagcctcctgagtagctgggactacaggcacgcgccaccacgtccagctaatttttgtactacaaccttcttataagcagatttggactgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaa

SEQ ID NO: 26753 - DNA, 3775 bp, Homo sapiens
ctttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaa

SEQ ID NO: 26754 - DNA, 11261 bp, Homo sapiens
tggcccctgctgcaggagcagcctcagcagcagcaggtgggaggccggaggcggtgctggcggtggcggcggcagccgtggcccggcggcctgggacagaatcagagtcaacggtggcctcggcggcggcggcggctgccgcggcggtggcgacggccgcggggactcggagctgagaggagctgctgctcggaccagcgcggttatatttcacactatgtgctgactgtatctacagaagatatttaaaaaaaaaaaagataaactttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtccctgagcagcagcctattactttgtgtagtggggttgaagacacaaagcattatgaggaagccaagaaatgtgtagaagaattagcattgtacttaaaaccgctcagcagtgctagaggagtgggtctgaacagcactactcagagtgttctgagtcgcccaatgcagaggaagcttgtgactctagtccactgtcaactagtagaagaagaaggcaggattcgtgccatgagggcagctcgatctttaggtgaacgaacagttacagagctcattctccagcaccagaatcctcagcaactctcttccaatctttgggcagcagtaagggctaggggatgccagttccttggaccagcaatgcaggaggaagctttaaagttggttctgctggccttagaagatggttctgctttgtcaagaaaagtattggttctgtttgtggtgcaaagattggagccacggtttcctcaagcctctaaaactagcattgggcatgttgttcagctcctttatagagcctcctgtttcaaggtcaccaaacgtgatgaagactcttctttgatgcagctgaaagaagaatttagaacctatgaagctctgcggcgagaacatgactcccagatagtgcagattgctatggaagcaggcttacgaattgcaccggaccagtggtcctctttgctttatggagaccagtctcacaaatctcatatgcagtccattattgacaagttgcagactccagcctcttttgcacagagtgttcaggaactaacaattgctctccagcgaactggagacccagcaaacttgaaccgactaagaccccatttggagctgttagcaaacattgaccctagtccagatgctcctcctcctacttgggaacagctggaaaatgggctggttgctgtgcgtacagtggtacatgggctggttgattatatccagaaccacagcaaaaaaggagcagatcagcagcagcctccacagcatagcaaatacaaaacatacatgtgtcgagatatgaagcagagaggaggatgccctcgtggggccagctgtacatttgcacactcacaggaggaactggaaaaatttcgtaaaatgaataagcgcctggttccgagaagacccttgagtgcctctttgggtcaacttaatgaggtgggcctgccttcagcagctatccttccagatgaaggtgcagtggatctccctagcagaaaacctcctgctctgccaaatggaattgtatcaacagggaatacagtaacacagcttattccgcgagggacagaccccagctatgattctagtctgaaaccaggaaaaatagatcatctgagcagtagtgctcctggatcccctcctgacctgctagaatctgttcctaagagtatttctgccttacctgtgaatccacattctatacctccaagggggccagcagatctgcctccaatgcctgttaccaaaccacttcagatggtacctcgaggttctcagttatatccagcacaacagacggatgtttattatcaggatcctcgaggagcagctccgccatttgaaccagcaccttatcagcagggtatgtattatactccaccaccacaatgtgtgtcccgctttgtccgacctccaccatctgctcctgaacctgctcctccctacttggatcattatccaccctacctccaagaacgtgttgtaaactctcagtatggcacacagccacagcagtacccacctatatacccatctcactatgatggccgtcgagtgtaccctgctccgtcttacacaagagaagagatattccgagaaagccctatacccattgagattccacctgcagcagtaccatcgtatgtaccagaatccagagaaagataccaacagatcgagagttactatccagtggctcctcatccaactcagatcagaccttcgtacctcagagaacctccttatagccggcttcctcctcctccccagcctcatcctagtctagatgaactacatcgccgacgaaaggaaataatggcccagctagaggaaagaaaggttatctctccacctccttttgcaccttcaccaaccttgcctcctacctttcatccggaagaatttttggatgaagacttgaaggtagctgggaaatacaaaggaaatgattatagccaatactctccctggtcatgtgacaccatcggctcctacattggaaccaaagatgcaaaacccaaagatgttgtggcagcagggagtgtggaaatgatgaatgtggagagtaaaggaatgagggaccagcgattagatcttcagagaagagcagcagaaaccagtgatgatgacctcatcccatttggagaccgaccaacagtgtctcggtttggtgccatctcacgaacttccaaaactatatatcagggtgctggtccaatgcaggctatggcacctcagggagctcctacaaaatctattaacatttcagattatagtccatatggaacccacggtggctggggagcttctccatattcacctcatcaaaacataccttctcagggacacttcagtgagagggagagaatatctatgtcagaagtggccagtcatggaaaaccccttccatctgctgagagagaacagctacgactagaattgcagcaattgaaccatcagattagccagcagacccagctacgtggactagaggctgttagtaacaggctggtgttgcagagggaggcaaacaccctggcaggccagtcacagcccccaccaccgccacctccaaaatggcctgggatgatctcaagtgagcagttgagcttggaactgcaccaggtggaaagggaaatcgggaagagaacacgggaactgagtatggaaaaccagtgttctctggacatgaaaagcaaactgaatacaagtaaacaagcagaaaatggacaaccagaaccacaaaacaaggttccggctgaggaccttacattgacattcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcagtgcttttcaaattaaacttttgctgacatcataggatgctaaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaaaaaaatatatatatatatatatatatatatatatatgtatgctttttcttttttttttggcttttgtttgctttttgacttttacttaaaacccttttacatttccactttaaatgcctattgtttattgggagaaggaaagaaacttttgtatgtctgacagagtcccaagatttttcatttctctgcataacagtaaaaggcaacattattggcctccaaccttctttttttttttttttttttttttttggagagggagtctgcttctgttgcccaggctggagtgcagtgggttgatctcggctcgctacaacctccacctcccgggttcaagcgattctcctgcctcagcctcctgagtagctgggactacaggcacgcgccaccacgtccagctaatttttgtactacaaccttcttataagcagatttggactgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgtgtataagcatttgtgcccaccccagcttctgctatcactgtggtcaagtcatgggtctgagtaaaagaattcttgagtatgtgactggtgagaaataactaactatagtcagtacatgtacagattgttaaaattcaagacaaaatactttcactaaaaaaaaggattcgtctcagtaaagaagtattcagttgctgtcacttacatacaaatggtggtgggtagcagtctcaccatttttctactctctttttgctcgttttaaataattgagtaaaggttttatttgtaaaatctatctgtaaaaagcacctgtaacgatttatatgtcattgaaaggaatggcccagttactttttaggagagattaataacctacctggaaattaactgcagtgtttacttagattttttccccctaataagagtctaagtgtgttaaatttttaactgatgatatggttacagtgttgcaaggtgatctcttcccctgaaaaatctgcctatccttttaagaaaaattagacctactaaactaaagcaaattttactttcatcattagcacctaaacaagcaagcagtctactactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtgtttgtggtgtcttccccttgttaccccttctgccctttttctctgactatggtaatttggtctttaggctcatatcagtctccccgagacattctgcagtcattatcacctttttgggtggattttattttgttttattttgttttttttaaaaaaataactttttaacattggtgcatatttgcttgggatagagcttgtgtaatttaccaatcgtattgattgtaagtgattgtgccctgcagaggtatatttaacaagacaaaaataatcttggttaataaaggagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaa

SEQ ID NO: 26755 - DNA, 4013 bp, Homo sapiens
ttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacc

SEQ ID NO: 26756 - DNA, 7269 bp, Homo sapiens
gggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacctgtcctgtctggtgcgaggatgttagaggttgataggactgacaaaagagcctgacagtggttcatgctataatttccacactttaggaggccaaggtgggaagactgcttgagctcaggagtttgagaccaacctgggcaatgtagtgagaccttgtctctacttaaaaaaacaaacaagggccgggtgcggtggctcacgcctgtaatcccagcactttgggaggctgaggcgggcagatcacgaggtcaggagatcgagaccaccctggctaacacggtgaaaccccgtctctactaaaaatacaaaaaattagccaggcgtggtggcgggtgcctgtagtcccagctactcgggaggctgaggcaggagaatggtgtgaacccgggaggcggagcttgcagtgagccaagattgcgccactgcagtccggcctgggcgaaagagcgagactctgtctcaaaaaacaaaacaaaaaaaaacacaaacaaaaaacccaaaaaaaccaaaaaattagccgtgcatggtggtgcatgtgggtagtcccaactacttggaaggctgaggtgggaggatcacttgagccaggagattgaagctgcagtgagctctgatcgccaccgcactccagccagggtgacagagtgagaccctgtattaaaaaaaaaaaaaaattgacaactgataaaccacaagctaatcctgggatgtgcacatggcctgggattagcctgtggttgggccaagtgaccttggtcaagatgctcagtgttgttgtaactaactaacttgctcaagaccacaaatgtaatatatggaagaggccatggaacaacctagaagagaatgagagctgggtaggtaaaggatgaatcccaagaccaattgggttgaagcaccaagtgagttcagatatttacactgatctagaagagatgggccttaaagaactgaaatctgaggacagttagtatgcccagttaggtcttcaggttaccctgggagatacatggtaccttttggatacagctgtagtacagctggactatggctcagaaaaggttggcccaggctgggcgccatggctcacgcctgtaatcccagcactttgggaggctgaggtgcgtggatgactcgaggccaggagtttgagaccagtctggacaacatggcgaaacgtggtctctactaaaaatacaaaaacttagctgcgagtgatggtgtgtgcctgtttgttaagtcttagccacttgggaggctgaggcatgagaattgcttgtgaacccgggaagcagaggttgcagtgagctgagattgcaccactgcactccagcctgaatgacagagcaagagtctgtttaaaaaaaaaaaaaaggttggcccagcctcgtgacagactgctgtgtgtgcgcaggcttgtacaaacctccctgaccaggcgcccaaggagcagggaaaagactactgagaatgcagcccctgggagaacaagattatgtgtccatctgctgtgactgagaagagaaaggaatcttgccaaaagggcataaaggatcgaggatgagccacaacactttgctcacattgccctagggagctgacctgttcagcacccagtgatgacctctgcttgatgccagccagcagcatgtagaggttcagaagagggaggcctccagcattctgctggagagatttatgatgatgatgttgagggctgcattgaaatacatgaaagaaatacatgaaaggatacaaaatagtatatacagtcagatctcagcagcaaagactggaagaaaatacataaaaaaccactgacattgaaatggcaataacacacactaaggcagagaagggacaagatgatcacctgcagccagcagaggccctttcctgtgagtgtgcactctgggtgtaagcaaccaataagggcaagtggggctgggtccaggttggagaggacagtgcctttggcaggatcctgaggagacagccttgttctgctgccctgtccggttgtttgtttggcctgaggctgaagagagaaatggaaatctatgtaggtcagtactcaaaggaggagcagctttttgtctccatagaggatggaataaaaagtatcttattcctaatactgaagcaaggctgaatggtgcctattcaaaaacaccaaatgtcctgggctagagtcaggaaagtaaacccctcccccgtgctgtccctactcccccaacatacacattttaaacagtaggtggaagccaaagtcaatcagatcaaagttgggggggggcggtggggtggccagggggcgcagtggtccttgatcttataggtccagagcctgttaatttgttcataaggtgagaactgaccctcaagagctggaaggattgggacatggcagccagtttacaaccatatggtgtcctgatgagcctgcactcagagtggagtgttggctggaacatgcacacctgcaactgagggttctaaagtcataggttaggcccttctcccgggtagggtctggacatgcacaccaggagtgacgttcccaactctagataactatgtgctaggctctgggctaagtgctttacataatgttgctcaggacaacaggacaaccctatgatttaggtgcacccattctacttggagggattgaggcttagatgttaacgtaacttgcctaaggttagagccattaagtttcaggagtctgatctgaactccgtctacacctgcactgtccagtgtggtagtcactagtgacatgtgaccatttgaagttgaattaaaataagaacttcagttccttagttgtgccagcttcatttcaattgctcagcagctgtctgtggctagtttggttggatactgcagatttatggatatttccactgctgcaaaaagttctattgaatagcacttgtctacactaaattgtctctcttccttttgttcttcaaataaatcagcctcaggtagcacaggagctgttctttgtaagcaggttgtatggatctgttctcaggtgtggatttttatttttttccctgcagatatggagtatattttctttaagaaattaaaaactaagaagaaaatgcca

SEQ ID NO: 26757 - DNA, 4097 bp, Homo sapiens
ttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacc

SEQ ID NO: 26758 - DNA, 4121 bp, Homo sapiens
ttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggtcagtggtgccgaagaccaaaacgggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatttcaaagttgttaaaagccacttcattaaatgctgggattggaagctgttggtctcctgacctgactctgggagccaacaaaacatcaggctcccaaactgctgggaaatttgtttctgtctgcaagggatagtgcgtgcataatccctgctgctgcttctcttgggacctgatttgcaccatccttagtttatgcggaaaggggaagcaatgggtggaggcagtggccttctccttaattttggcttggcttctgatccttttcccaactagaagtcttaagccacttttcgctgaaaatgaaatccctcccttatccatggtagttttaaatttggtttcattgaagaaatagatttaggcaaagagcctgtgctcttctctggccagactgctgttgaagttcctggagagcaaatgttaagacagagcacttaagagctttcaggaggtactgaatgagactggattctgttgtaagccgacagttcaagtctttatttcccaggttggtggggagtgaggagaccctactttcattccctttcctagcccactgatttttgggggcaggtcagggagaaagcattttttttttttttttgagtctcactctgttgcccaggctggagtgcagtggtacagtcttggcttactgcaacctccacctcccaggttcaagctattctcctgccttagcctccagagtagctgggattataggcgcccaccaccacaccaggctaatttttgtatttttagtagagacggggttttaccatgttcaccaggctggtcttgaactcttgaccttatgatccgcccgcctcagcttcccaaagtgctgggattacaggcgtgagccaccacacccagcaggagaaaccattttctaggctctttaggaaggaccatgcaatgagtaggtgatgtatttgagccctcacagtctttacacccctagaggagctggaggacttaagagtttgctgcagaagcgtggccaagcacaaaacacatgatcaggaaagcagagtgttttcccattaccaatggatgaactatgcaaaccctaaacgccttggcagacacctcccaccccttacccctcccatgcagctgaaaaatctgagactagaaccaatcatgactctggatggcagagggaaacctctaaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatctagcagtaacttaagggcagaagctggctctctacttacaacctgctttctctgctgaagccttacctcctcttcagtttccctcctagacacaaatcgaaaataatatactgatagctggttagtaacctcagtaagaattaaaactgaggttgtttactcattttgcctttaaatcttttatccccttttggtgaaggtttccctttaggaaaaaaggtgtcaaacaaccctgattttttttttttttgcatcatttttattacaccaaattaaagttgggagttccaagatcccattccagttaatatttaaccaaggtctaaaatttgattttttttaaatctttgaatcctcccttctgcccctcatggatccttggttttaatgatatggaaacatctaattcttagaattattccgtagcttttgctgattactctgagatttcagttaagacttgtttcaaaagacagatagctgactggttcataatacattggaatagttggatccaaactaataagaataagctgtacaggaactagtgctcaatatacattgtataaatttgtggaaatctcttggatgtgaattgttacttcaagtggcttttattaagattttctcagacttacttggaggttaaagcaaacccaaatgtgtattattttgttacagagctctgctttataattttgtaataaagtttcaatacagacacc

SEQ ID NO: 26759 - DNA, 1100 bp, Homo sapiens
aggttgcagttgactgcggttggttcaggctgagttgtttgggaagtacaaattttgcccagcgtgagtcagcactgccctgggtaaactccctgctgtgttgcaatcttgcttaccaaagatacatccccaggcggcaccattcacttcacatgaaagccgctgctcttggttcctgagatgatctcatctgaacatggctccagcgacctcagccacaggaactagagacagcttgctttctgtcgtggcaatgttttgaaactggcaaaatcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccagcccaggttcaggagaatcagcaggccaatggccatgtgtctcaggatcaagaggaacccgtctacctggagagcgtggccagagtacctgctgaggatgagacccagtctattgactcagaggacagctttgtcccaggccgaagggcctctctgtctgacctgactgacctggaggacattgaaggcctgacagtgcggcagctgaaagagatcttggctcgcaactttgtcaactacaagggctg

SEQ ID NO: 26760 - DNA, 489 bp, Homo sapiens
aaggagttcaagttgcttgccagactaacttacttttaaaagtaagcagccttccaagttaagagatgattttaaatttcagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtc

SEQ ID NO: 26761 - DNA, 893 bp, Homo sapiens
gtcagggtgggtacctcaggcaggtttgctggaaaattccagtaaacagtttcaaaggagttcaagttgcttgccagactaacttacttttaaaagtaagcagccttccaagttaagagatgattttaaatttcagggaaagtggaagaggagaccctagcaggcttcaagcaagctctgtaggacagcagttagacactgtttttgaggactaaattgccaagtctgtcttttaagaagagggtgaggggagtttgggaaggaatgttcaagccctgagtgaagatccaataattttctttcaagatcagaaggagattttatcatgtgggcaacctgctgcaactggttctgcctggatggacagcctgaggaggtcccaccaccccagggagccaggatgcaggcctattccaaccctgggtacagctccttcccttccccaacaggcttggaaccaagctgcaagtcctgtggggctcactttgcaaacacggccaggaagcagacctgcttggactgtaagaaaaatttttgcatgacctgttcgagccaagtagggaatgggccccgcctctgccttctctgccaacggtttcgagctacagcctttcagcgagaggagctcatgaagatgaaggtgaaggacttgagggactatctcagcctccatgacatctctaccgaaatgtgccgggagaaagaagagctggtgctcttggtccttggccagcagcctgtaatctcccaggaggacaggactcgtgcctccaccttgtccccagactttcctgagcagcaggccttcctgacccagcctcactccagcatggttccacctacctcacccaacctcccctcttcatctgcacaagccacctctgttcccccag

SEQ ID NO: 26762 - DNA, 720 bp, Homo sapiens
gggccgggccggctggggatgggtgggagggggggccgacttcctggggccgcccgtgaggatgtcgcgaccgcccccgggtgcccctcagccccagagacgccgccgcggcggagtccgcagcctccctgcctgaggcgtccgcggccgggatccggcccctcccctcgcctcctctcctaggtgccggccgggagggcggccgcagcagaactttgggggaagtgagaactgtgagcacaataatcttcagagaatgcacagtcctttgggtatttgtctactcatcagctgcttagtcagatggagtgttttcctaagtactactgaagtacacagttcagtctttattttgaaatctctccttctgccttctctccctcttccattactttgattaccttgatgggacattcaagctgtgcagtcgtatccttttatttctatagcctgcagaaaccaggttgaagattaactgtaggtgaacaggtaatcttatctacttggctagaaatcacccttcaagatgaaacacgtgttgacaaaggccccctagacttggggacatgaacaaagattttatcatgtgggcaacctgctgcaactggttctgcctggatggacagcctgaggaggtcccaccaccccagggagccaggatgcaggcctattccaaccctgggtacagctccttcccttccccaacaggcttggaaccaa

SEQ ID NO: 26763 - DNA, 2124 bp, Homo sapiens
atgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcaaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagaggaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatga

SEQ ID NO: 26764 - DNA, 2566 bp, Homo sapiens
gggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcaggctggagtgcaatggcgctatcttggctcactgcaacctccacctcccaggtacaagcgattctcctgcctcaccctcccaagtagctgggattaccggcgcctgcctccacacctgacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggttctcgcactgtta

SEQ ID NO: 26765 - DNA, 3033 bp, Homo sapiens
cacctataccattcattccagtctcctcaattctttcactgtattaagacggcctgccctctggcacgttttctggaacgaaagcggcttgggacagacagactcccttcgccagggagccccgaccccgagggcgcgccctgagcgtctgagcgcagccccgctgcgtccccagttgtatcccccgccacgcccgcctcttccgccgctcgcgcgcgcgcgcacggccggccacggcgcgccggggttggctgctacagggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaagaaacaactggaagcagaatcacatgcagcccaactacagattcttatggaattcctcaaggttgcaagaagaaataagagagagcaactggaacagatccagaaggagctaagtgttttggaagaggatattaagagagtggaagaaatgagtggcttatactctcctgtcagtgaggatagcacagtgcctcaatttgaagctccttctccatcacacagtagtattattgattccacagaatacagccaacctccaggtttcagtggcagttctcagacaaagaaacagccttggtataatagcacgttagcatcaagacgaaaacgacttactgctcattttgaagacttggagcagtgttacttttctacaaggatgtctcgtatctcagatgacagtcgaactgcaagccagttggatgaatttcaggaatgcttgtccaagtttactcgatataattcagtacgacctttagccacattgtcatatgctagtgatctctataatggttccagtatagtctctagtattgaatttgaccgggattgtgactattttgcgattgctggagttacaaagaagattaaagtctatgaatatgacactgtcatccaggatgcagtggatattcattaccctgagaatgaaatgacctgcaattcgaaaatcagctgtatcagttggagtagttaccataagaacctgttagctagcagtgattatgaaggcactgttattttatgggatggattcacaggacagaggtcaaaggtctatcaggagcatgagaagaggtgttggagtgttgactttaatttgatggatcctaaactcttggcttcaggttctgatgatgcaaaagtgaagctgtggtctaccaatctagacaactcagtggcaagcattgaggcaaaggctaatgtgtgctgtgttaaattcagcccctcttccagataccatttggctttcggctgtgcagatcactgtgtccactactatgatcttcgtaacactaaacagccaatcatggtattcaaaggacaccgtaaagcagtctcttatgcaaagtttgtgagtggtgaggaaattgtctctgcctcaacagacagtcagctaaaactgtggaatgtagggaaaccatactgcctacgttccttcaagggtcatatcaatgaaaaaaactttgtaggcctggcttccaatggagattatatagcttgtggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggagtccaatgtgctgattgctgctaacagtcagggtacaattaaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccaca

SEQ ID NO: 26766 - DNA, 1027 bp, Homo sapiens
gggaccgcggtggcggcggcggcctcgacagcggtagtgccttctactccgcttttttagtttcctccgccccctcccgtgggacgctgttgtgtggctgccttaaaaaaaaacgcaactttattgttcctcagccccacctccggctcggcgggcgtcctcaggatgcactgaggctgaggggaggggaggcggcggagggtcgaggtcgcggtccctctcctccgagcgcccggctggaggggagggagtcacgatgtctggtagccgccaggccgggtcgggctccgctgggacaagccccgggtcctcggcggcctcctcggtgacttccgcctcctcgtctttatcctcttccccgtcgccgccttccgtggcggtttcggcggcagcgctggtgtccggcggggtggcccaggccgccggctcgggcggcctcgggggcccggtgcggcctgtgttggtggcgcccgccgtatcgggtagcggcggcggggcggtgtccacgggcctgtcccggcacagctgcgcggccaggcccagcgccggcgtaggaggcagcagctccagcctaggcagcggcagcaggaagcgacctctcctcgcccccctctgcaacgggctcatcaactcctacgaggacaaaagcaacgacttcgtatgccccatctgctttgatatgattgaagaagcatacatgacaaaatgtggccacagcttttgctacaagtgtattcatcagagtttggaggacaataatagatgtcccaagtgtaactatgttgtggacaatattgaccatctgtatcctaatttcttggtgaatgaactcattcttaaacagaagcaaagatttgaggaaaagaggttcaaattggaccactcagtgagtagcaccaatggccacaggtggcagatatttcaagattggttgggaactgaccaagataaccttgatttggccaatgtcaatcttatgttggagttactagtgcagaagaataaaaaaaaaaaaaaaaaaaaaaaa

SEQ ID NO: 26767 - DNA, 4952 bp, Homo sapiens
aagtggcagttggcgtaggtgcattcggagtgcggccgaggtaactaccgagtcttcggcgggctcgcgagcccggccgcggcctgctggtttcagtgatggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgaccaacttcatcagcggactgcagagacttcatggcatgctggaattcctgagaccttcatcttcaaaccacagtgtagggccaatgagaacaagaaggagggtatctgcttcacggagggcaagagccggagggtctcagaggacagacagtgccaggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaagagcaactagcaggtgtctcagcagagcaagaagttacatgtatcgatggaggcaagaccctccccaaacagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccagtgcaacaagaaagccaggcacagtgacattgtcgtcctttatgcccgaaccctgagagctttggacactagtgaacaggagcgcatgaaaagttccctactgaaggaacagatgctaaggaaacaggccgagttagaatcagcacagtgccgactccaactgcaggtcctcactgataagtgcactaggcttcaaaggcgtgttcaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaaaaaacaaacaaacaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgta

SEQ ID NO: 26768 - DNA, 3321 bp, Homo sapiens
atggctcatgaagcaatggaatatgatgttcaggtgcagttaaatcatgccgaacaacagccagctcctgctggcatggccagcagccaagggggaccagccctcctccagcctgttcctgctgatgtggtcagcagccagggggtaccatccatcctccagccagctcctgctgaggtgatcagcagccaagcgacaccacccctgctccagcctgctccgcaactgtctgttgacctgacagaagtggaggtcttgggagaagacactgtggagaacatcaatccaagaacttcagaacaacataggcagggatctgatggtaatcacaccatcccagcatcttcgttgcattcaatgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagcttttacttgagtctcccctagtgtcagagatcaggagaaaagacataagagaatttacaaaagctattcagactgctattgaaaacatgagaagaacttgtctcccattttgagagttcctatctaaataaagccaattcctcagactgaggggctgttcttaagtgttctttatacattccagttatccagttaaagccttccccatgtgaagctgatgtttgattccagtttcctttgatttgcctccctaaccttttctagggctcagtttgtatttctttgccttgcctcagactactttgccaacccacttccacaacagaatatgcttcaagatgtgggcaggtcagtgtcctgttcatgggagaaaatggcttaacagtctgattttctcaaatgattattgaagagttgttatcgtttttattataaaacacttctgacctgtcaattcaagagctgtttctaggatctttctctccggcaaggggttgttgcactagatttccccagagttccaagttctagttgtgccttttaatgaccctttaatattttaggacataattttttccttttttaaatttttttgtagaaatagatgtttcactacgttgtccaggctggtcttggactcctggcctcaagcaatcctcccacctcagcctcctaaagtgccaaaattataggcgtgagccactgcacccggcccctatttgaagacgtcttttgtaaaagctagcttctagaacctgagaaaagctcttttctcagaggagatactccttttgatatgttaatgattaagagtggttgcccaggcctagtttcagtggcagaataggattggaattaaaaagcagaactcatctggcttcagcagattgccaccaagaggatacaggtggtcaggtcctggctggctttgtctttgggcctgggcaggcttaggatttgactttctttgaagtacctgatgctgattgattccactaatagtaggaagcaagagacttaactatgagggacgttatgtgaatcttaagtcttaccagtccttgcattagtacattaaatttggatgttttggaagcaaattcatacgatcgtgagtgatttctccaaagaaaaaaagccttgtccagcctgaccaacatggtgaaaccccatctctactaaaaatacaaaaattaactgggtgcagtggtgcgcatgcctgtagtcccagctacttgggaggctgaggcaggagaattgcttgaaccctgggaggcagaggttgcagtgagtcgagatcgcgccactgcactccagcctcggtgacagagcaagactccatctcaaaaaaaacaaacaaacaaaaaaaaaccctgatgccattcccagtccccgttgtaggacatcacatttataaatccaggctttagtcttctgggctccaccagtctctgccccaccatattcctttgtcactacctctaagtttttttccccacttgaggatttggagttaaacgaactcaaaatgtcttgtcattgtatgtattcttgcccctgctttgaaaacagggccatgggaactctgtttatgccctgttttaatgtttctgttttatgttttactgttaatatgaaaataaagaatttgctatgta

SEQ ID NO: 26769 - DNA, 3276 bp, Homo sapiens
gcttccttgtgagaatctaggtctctaagggaagcgttacttgaggctcggttgggaagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgta

SEQ ID NO: 26770 - DNA, 3398 bp, Homo sapiens
gggaaagaaaccagtagcgggacggagggcgggggtggcaagaaagtcaaggtttagaagtaagccggagacgcctaaccctggtaacatccgaatgggaacgggataggaaggaaggcctttgagagaggaggcgtaaacccaggaacagtgacagtgtaggacgaaaggcctaagtttgttgcggaagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaa

SEQ ID NO: 26771 - DNA, 3867 bp, Homo sapiens
gacagacttcagaatttattagggtttgtaatttccaggttccaaagcacagcaagggaaagggcctggctgggtagtacgttacacccggaagtaaagagacgcatacaccgttgggtgcactttatagtctggctggcaaacgagcgacaccgacgcgcagagttaagtgctgggacttcccaagcctggaaagcagaccgtgtctctgcaactacgcggctgccacgagcgctgagcggccgggcatttggcctcgaggaggaggcactgtaagggcggcgcaagagggcggaacgcgggacgccaggcaccctagctcccgacggacgcagttttcagttgcacgggcgagctccgggccggctgcggagcgactccccgccgccaagtgggcggcgtggctgtcgggaaagaagggctggggcctgccgttcttcctcccgagtatcccctccagctggacgaccccacgctgcagcacgggcttccggcttctctcctcagtggccaattcgagggcacagcgggctccggaggcgcggcggcaagcctatcccgcctcccaaccacagcctccagcacccgagagaacggccgcccacagcacacgttctccggacaggagggcgaaggcccaagacctggagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgtgagtcgaacaaacccgaacaatggagagtttcggtttagtttggaaatccacgtaaatcatgaaaatagaggatttgaaattcatggagaagattatacagacattccactttcagatagtaacagagatcatactgcaaataggcaacaaaggtcaactagtcctgtggctaggcgaacaagaagccaaacctcagtgaatttcaatggtagtagttccaacattccaaggactaggcttgcttcaagggggcaaaatccagctgaaggatctttctcaacattgggaaggttaagaaatggaattgggggagcagctggcattcctcgagctaacgcttcacgcactaatttcagtagtcacacaaaccaatcaggtggtagtgaactcaggcaaagggaggggcaacggtttggagcagcacatgtttgggaaaatggggctagaagtaatgttacagtgaggaatacaaaccaaagattagagccaataagattacgatctacttccaatagtcgaagccgttcaccaattcagagacagagtggcactgtttatcataattcccaaagggaaagtagaccagtacagcaaaccactagaagatctgttaggaggagaggtagaactcgagtctttttagagcaagatagagaacgagaacgcagaggtactgcatataccccattctctaattcaaggcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggtaattttgtcatgctaagcacttttgtatctgcacaattcagtaggttaagaatcaatcttctttttcttaatagtacagcagactttagcttcaagtttcataggcttagtacttatatctagacatttgtgtctaaataagcttttcattaactttttattttaaggacagtatcttttcatgaaagagtatttggctgaatgtttgctatatatatgttacttgaaatgttaaatttaatatgcagcataccataggtgtatatataggtatataattttaaggttaaaatattcagtctacaagtttggttcttatttaagcttttgggctaatactgcatatggcacaatgtttaatattggcaagttcatctcagagaaaggggattcagatataattttaaagtagagataatttactgaagcgtctctgacaatctaacttattagacagcaagcaatatataatactgaaaaagtattcagaaatggaaaatttacatcatataggttatttaacttgtgttcagcctttttgtaacttttttgaaagtgcaaacaattctttggattattaaataaggtatacagtatgcatggtttctcaaatttagttttaaaatctaaaagtctataaagaatcagatgcataggcaatatgttaagttcacttggaggctaaaaatctccagtgaaaacaaaacgaaaacctttaagagaatgtagagtttatataaacacaaagtatgcattgaagatctgtttctaccaataaacattaaaacaaagactgta

SEQ ID NO: 26772 - DNA, 1524 bp, Homo sapiens
gaagcgttacttgaggctcggttgggaagagatgggcagctctcaaaaaaggcacaaacaattgaaggatggataccatggcatatgttaaaagcgtgttgaaaggaaaataagaaagccaggaatctcaggatgaatcagtctagatcgagatcagatggtggcagtgaagaaaccttacctcaagaccataatcatcatgaaaatgagagaagatggcagcaagagcgtctccacagagaagaggcctattatcagtttattaatgaactcaatgatgaagattatcggcttatgagagaccataatcttttaggcacccctggagaaataacatcagaagaactgcaacagcggttagatggcgtcaaggaacaactagcatctcagcctgacttgagagatggaacgaattacagagactcagaagtccctagagaaagttcacatgaagattctcttctagaatggttgaacacctttcggcgcacaggaaatgcaactcgaagtggacaaaatgggaaccaaacttggagagctgcttgtgtcaagaataacagtagaagaaggagaagaatccagcagatcctcaactgctgtacgacgacatccaacaatcacactggaccttcaagtgagaaggatccgtcctggagaaaatagagatcgggatagtattgcaaatagaactcgatccagagtagggctagcagaaaatacagtcactattgaaagcaatagtgggggctttcgccgaaccatttctcgtttagagcggtcaggtattcgaacctatgttagtaccataacagttcctcttcgtaggatttctgagaatgagcttgttgagccatcatcagtggctcttcggtcaattttaaggcagatcatgactgggtttggagaactgagttctctaatggaggccgattctgagtcagaacttcaaagaaatggccagcatttaccagacatgcactcagaactgagtaacttaggtacagataacaacaggagccagcacagggaaggttcctctcaagacaggcaggcccaaggagacagcactgaaatgcatggtgaaaacgagaccacccagcctcatactcgaaacagtgacagtaggggtggcaggcagttgcgaaatccaaacaatttagttgaaactggaacactacccattcttcgccttgctcacttttttttactaaatgaaagtgatgatgatgatcgaatacgtggtttaaccaaagagcagattgacaatctttccaccaggcactatgagcataacagtattgatagtgaactaggtaaaatctgtagtgtttgtattagtgactatgtaactggaaacaagctcaggcaattaccttgcatgcatgaatttcacattcattgtattgaccgatggctctcagagaattgcacttgtccgatctgtcggcagcctgttttagggtctaacatagcaaacaatgggtaaggtgatgggatctactcaaatactgttttttagtagaa

SEQ ID NO: 26773 - DNA, 1752 bp, Homo sapiens
gtgacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgca

SEQ ID NO: 26774 - DNA, 1752 bp, Homo sapiens
gtgacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgatggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgca

SEQ ID NO: 26775 - DNA, 1750 bp, Homo sapiens
gacgtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgca

SEQ ID NO: 26776 - DNA, 1752 bp, Homo sapiens; identical to SEQ ID NO: 26773

SEQ ID NO: 26777 - DNA, 1752 bp, Homo sapiens; identical to SEQ ID NO: 26773

SEQ ID NO: 26778 - DNA, 1752 bp, Homo sapiens; identical to SEQ ID NO: 26774

SEQ ID NO: 26779 - DNA, 3084 bp, Homo sapiens
gcagtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatcatcttccatgttgcagttagtctttcttttcattacaagtctttcacagaagtttggtggtaatattgaaagaactagcattgggcagaatgtgtcttttttaggcactttatattctcaacatacaatgttaagaaccatcaattttgacttttactaagttgttaaataaagttataatacagctgtgaagggctaaa

SEQ ID NO: 26780 - DNA, 3212 bp, Homo sapiens
gggtgagtccagcagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaa

SEQ ID NO: 26781 - DNA, 2440 bp, Homo sapiens
agatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaagtggtaa

SEQ ID NO: 26782 - DNA, 581 bp, Homo sapiens
gcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtgaccagtgagcagagtccgtgcttgctatctgtctcatgttacagagcttccattacatattaa

SEQ ID NO: 26783 - DNA, 2817 bp, Homo sapiens
gcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaa

SEQ ID NO: 26784 - DNA, 2654 bp, Homo sapiens
atagagctgatgtatccagaggttatgttgctagaggtgagatcagttacctacgtgcaactgaaatttcaaacttctgttcagcagggacgtgagtggacaatggtgactgatagttggaaatatcagcaaacatcttaaattttatactcaaatgaatgagcaatgaaccaggagaataggtccagttttttttggctccttgtaatttttacctttttacttaaaattacagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacatgtgttgacccatggctgttagaacacaggacttgccccatgtgcaaatgtgacatactcaaagctttgggaattgaggtggatgttgaagatggatcagtgtctttacaagtccctgtatccaatgaaatatctaatagtgcctcctcccatgaagaggataatcgcagcgagaccgcatcatctggatatgcttcagtacagggaacagatgaaccgcctctggaggaacacgtgcagtcaacaaatgaaagtctacagctggtaaaccatgaagcaaattctgtggcagtggatgttattcctcatgttgacaacccaacctttgaagaagacgaaactcctaatcaagagactgctgttcgagaaattaaatcttaaaatctgtgtaaatagaaaacttgaaccattagtaataacagaactgccaatcagggcctagtttctattaataaattggataaatttaataaaataagagtgatactgaaagtgctcagatgactaatattatgctatagttaaatggcttaaaatatttaacctgttaacttttttccacaaactcattataatatttttcataggcaagtttcctctcagtagtgataacaacatttttagacattcaaaactgtcttcaagaagtcacgtttttcatttataacaattttcttataaaaacatgttgcttttaaaatgtggagtagctgtaatcactttattttatgatagtatcttaatgaaaaatactacttctttagcttgggctacatgtgtcagggtttttctccaggtgcttatattgatctggaattgtaatgtaaaaagcaatgcaaacttaggcgagtacttcttgaaatgtctatttaagctgctttaagttaatagaaaagattaaagcaaaatattcatttttactttttcttatttttaaaattaggctgaatgtacttcatgtgatttgtcaaccatagtttatcagagattatggacttaattgattggtatattagtgacatcaacttgacacaagattagacaaaaaattccttacaaaaatactgtgtaactatttctcaaacttgtgggatttttcaaaagctcagtatatgaatcatcatactgtttgaaattgctaatgacagagtaagtaacactaatattggtcattgatcttcgttcatgaattagtctacagaaaaaaaatgttctgtaaaattagtctgttgaaaatgttttccaaacaatgttactttgaaaattgagtttatgtttgacctaaatgggctaaaattacattagataaactaaaattctgtccgtgtaactataaattttgtgaatgcattttcctggtgtttgaaaaagaagggggggagaattccaggtgccttaatataaagtttgaagcttcatccaccaaagttaaatagagctatttaaaaatgcactttatttgtactctgtgtggcttttgttttagaattttgttcaaattatagcagaatttaggcaaaaataaaacagacatgtatttttgtttgctgaatggatgaaaccattgcattcttgtacactgatttgaaatgctgtaaatatgtcccaatttgtattgattctctttaaatataaaatgtaaataaaatattccaataaaa

SEQ ID NO: 26785 - DNA, 839 bp, Homo sapiens
tggaggaggggcaagcaaaggggaatgtagataactaaagtgaaatagagctgatgtatccagaggttatgttgctagagcatctttttcaatgagtgcctatgtgactgtgacttattacaatgaaaccagcaactacactgcaatagagacatgtgaatgtggcgtttatggattagcttcaccagtggctaatgctatgggagtggtaggcatccctaagaacaataactaccaagcttgtgaccacaacactgagtttagtaatactaagaagccctggattgcgctgatagaaagaggtaattgtacattttcagaaaaaattcaaacagcgggcagaagaaatgctgatgctgttgtgatttacaatgctccagagactggcaatcagacgatacagatggcaaattttggtgcagtagacattgttgcaatcatgatcggcaatctgaaaggcacaaaaattctgcaatctattcaaagaggcatacaagtgacaatggtcatagaagtagggaaaaaacatggcccttgggtgaatcactattcaatttttttcgtttctgtgtccttttttattattacggcggcaactgtgggctattttatcttttattctgctcgaaggctacggaatgcaagagctcaaagcaggaagcagaggcaattaaaggcagatgctaaaaaagctattggaaggcttcaactacgcacactgaaacaaggagacaaggaaattggccctgatggagatagttgtgctgtgtgcattgaattgtataaaccaaatgatttggtacgcatcttaacgtgcaaccatattttccataagacat

SEQ ID NO: 26786 - DNA, 1905 bp, Homo sapiens
gagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcaa

SEQ ID NO: 26787 - DNA, 2070 bp, Homo sapiens
gagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcaaca

SEQ ID NO: 26788 - DNA, 251 bp, Homo sapiens
ggaaagaggctcctgaagcacaaatgcagggttctctgttgcccaggctggagtgcagtggcacaatcactgcagcctcgatctctcaggctcaggagaactcctggaagccccgtcttcctcctcatgcccattgcctgaccagagccaccctgcactcaggagagcttctcggtttgctcagtgtccctccacggggggagctgattgcaaaggcaaagcaggttgagactctagacccaagagcactc

SEQ ID NO: 26789 - DNA, 624 bp, Homo sapiens
gcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgg

SEQ ID NO: 26790 - DNA, 2094 bp, Homo sapiens
gccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggttctctgttgcccaggctggagtgcagtggcacaatcactgcagcctcgatctctcaggctcaggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 26791 - DNA, 1946 bp, Homo sapiens
gttggccatggcgggcctgggcctgggctccgccgttcccgtgtggctggccgaggacgacctcggctgcatcatctgccaggggctgctggactggcccgccacgctgccctgcggccacagcttctgccgccactgccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgc

SEQ ID NO: 26792 - DNA, 2637 bp, Homo sapiens
gactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaata

SEQ ID NO: 26793 - DNA, 2937 bp, Homo sapiens
gccggcggtcgcgccagcgggatccgcctggctcagctgacagctcccgagaacggaagaggcggcgcgccggttgagcagggcgtctctaggcctggtcggctggcggcggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataatt

SEQ ID NO: 26794 - DNA, 2859 bp, Homo sapiens
ggtctctggtctcccctctctgagcactctgaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataatt

SEQ ID NO: 26795 - DNA, 2905 bp, Homo sapiens
ggaagaggcggcgcgccggttgagcagggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataatt

SEQ ID NO: 26796 - DNA, 1229 bp, Homo sapiens
gtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaag

SEQ ID NO: 26797 - DNA, 3067 bp, Homo sapiens
gtgagtgggccccaggcaagggcggagggcggaactttggggttcggcactgccgggcggccggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataatt

SEQ ID NO: 26798 - DNA, 4235 bp, Homo sapiens
gcgcagagtcctccctatgccggcggtcgcgccagcgggatccgcctggctcagctgacagctcccgagaacggaagaggcggcgcgccggttgagcagggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaacagagttgctgctatttgttctgtcaccaaggcaactaatcacattttaaaactgttcggcatataacatattcttaaagtaagaaaaaaaaggtcacagaatagcatctcttttacctgggcttgtgactgagcttaggttttagggcccatattttgtttaaaccagatagtttcatggtcttccattcaggacattttgtgtaaaaattgaggttaatttgctgggcacagtggctcacgcctgtaatcccagcactttgggaggcctaggcgggcggatcacgaggtcaggagttcgagaccatcatggctaacacggtgaaaccccgtctctactaaaaatacaaaaaattagctgggcatggtggcaggcgcctgtagtcccagctactcaggaggctgaggcaggagaatggcatgaacctgggaggtggagcttgcagtgagccgagatagcgccactgcactccagcctgagcgacagagcgagactccttctcaaaaaaaaaaaaaaaaaaaattgaggttaaagaataaattaaagataagaaatggaaattaaaatgatttgttctacagtatatacctgagaagagtgatttctgtgatcaaagagttcaattcagatttattcagaaagagctactcagaagctctatagttcgtgagctacttgatattttctagagatcattttatgttaagctgttatacattgttgatgatgtcatagaagtaggaaagaagcctttataatacagttttatgaaagaaatgggagccttttttcccatttatgatattaaaaacaacacaggtatttggtgtttagtctcaaaaatttgtttggtcaccttagtgattcttaggtacaaagtcttcatcactcaattttaacaaagaaaatagggcttataaagttatacttttgaagcatgagttatgagctaattttaagatgtatagttttggtagagtacttttgtctcagtaaaatgaaagatttgggtaactccccaaatgccctgtaaaacaaatgggtttgtggaaggttgtggtgtcagcaaaatatatgatagaataaagagttttgtaccta

SEQ ID NO: 26799 - DNA, 575 bp, Homo sapiens
agagaaggggaccgggctgggactgtacactgggcctcagtccctcaaatccgggaccgggcgtccgcagctcggctggccgggactcccttcgggacgctgaggaggaaggggaaggtgtgggccctgctccttcgggacgccccaggctggccagcagctcacacatccgcattgcgccctctgatcccagcgttggggcggatagctagcgttgggcctgcccctgttttggggcagtcgcccaaacgacgccgcacgcctagtggcgagctgaacccagactaggacacccgaagaccaaatggatagagtgagaaggaaatgggggttagcaacctgaattgagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccc

SEQ ID NO: 26800 - DNA, 667 bp, Homo sapiens
ggccggggctccggggacaggccagatgggaagctgctgtccacgcagcaaggcggctgctgagggaaagggagcctctgcatcaccaaatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaaga

SEQ ID NO: 26801 - DNA, 582 bp, Homo sapiens
gagaacggaagaggcggcgcgccggttgagcagggcgtctctaggcctggtcggctggcggcggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggagga

SEQ ID NO: 26802 - DNA, 815 bp, Homo sapiens
ggctggcggcggtgagtgggccccaggcaagggcggagggcggaactttggggttcggcactgccgggcggccggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagag

SEQ ID NO: 26803 - DNA, 473 bp, Homo sapiens
ggaccgggctgggactgtacactgggcctcagtccctcaaatccgggaccgggcgtccgcagctcggctggccgggactcccttcgggacgctgaggaggaaggggaagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtg

SEQ ID NO: 26804 - DNA, 938 bp, Homo sapiens
ggaggatgaggccggggctccggggacaggccagatgggaagctgctgtccacgcagcaaggcggctgctgagggaaagggagcctctgcatcaccaagtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcag

SEQ ID NO: 26805 - DNA, 563 bp, Homo sapiens
atttcccaagctggttggtgcatgggcttcctcacttttttcctcacgaagaggtctctggtctcccctctctgagcactctgagatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcac

SEQ ID NO: 26806 - DNA, 1191 bp, Homo sapiens
agctgacagctcccgagaacggaagaggcggcgcgccggttgagcagggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcgagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactg

SEQ ID NO: 26807 - DNA, 2140 bp, Homo sapiens
ccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatatattggagtaattcaagattctgtggttggcccttttgactgctctctctacaggtttaatttgggcatttactcattttcatggctccaaggaccatgtatgtgttggggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatc

SEQ ID NO: 26808 - DNA, 2267 bp, Homo sapiens
gcgcgcgttcccggcagctgcgggctccgaggccagagagaaaagactgcgaggtggccgcagctgtggccggagagcacaaagaatgaaccagcagtggaagagaaaatactgtaagctggctgactgctggtgaagaaaatgctttatttttgtggcaggcatctgtgggatctgtaatagaaatgggatcttcaatattcatgttattttctcctttggtcttatatgattgttacctttatgaagctttagtgattacaaagcactttttttgtccatttttacctgagctttgtaaactctgatttgcaggatggctggctgtggtgaaattgatcattcaataaacatgcttcctacaaacaggaaagcgaacgagtcctgttctaatactgcaccttctttaaccgtccctgaatgtgccatttgtctgcaaacatgtgttcatccagtcagtctgccctgtaagcacgttttctgctatctatgtgtaaaaggagcttcatggcttggaaagcggtgtgctctttgtcgacaagaaattcccgaggatttccttgacaagccaaccttgttgtcaccagaagaactcaaggcagcaagtagaggaaatggtgaatatgcatggtattatgaaggaagaaatgggtggtggcagtacgatgagcgcactagtagagagctggaagatgctttttccaaaggtaaaaagaacactgaaatgttaattgctggctttctgtatgtcgctgatcttgaaaacatggttcaatataggagaaatgaacatggacgtcgcaggaagattaagcgagatataatagatataccaaagaagggagtagctggacttaggctagactgtgatgctaataccgtaaacctagcaagagagagctctgctgacggagcggacagtgtatcagcacagagtggagcttctgttcagcccctagtgtcttctgtaaggcccctaacatcagtagatggtcagttaacaagccctgcaacaccatcccctgatgcaagcacttctctggaagactcttttgctcatttacaactcagtggagacaacacagctgaaaggagtcataggggagaaggagaagaagatcatgaatcaccatcttcaggcagggtaccagcaccagacacctccattgaagaaactgaatcagatgccagtagtgatagtgaggatgtatctgcagttgttgcacagcactccttgacccaacagagacttttggtttctaatgcaaaccagacagtacccgatcgatcagatcgatcgggaactgatcgatcagtagcagggggtggaacagtgagtgtcagtgtcagatctagaaggcctgatggacagtgcacagtaactgaagtttaaataaaaatgtcttcagctccatgctcaaggttgaaagggttacctgtaaatttctgcccacataacattatactcatccctagtagtgcattttgggagttggggtgggaaggggtatgggaaggatagactcataattaaaatgtctaacatgtctctgttgagaaatttatttaatgtaaggaacttgggtgttaatagttgagagctgtttagtaataacccagttttcttgaggtctgtttactttatactttttaaaaacttctgtagttcttttggccagtgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaacagtttgtctcttgtttgagggtggaaagggtgtggaaacattttgacatttgtgaccaaaggtcacttaaaaagtggtggttttaattggttgttttcagcttaatcacctgctcagaaaagtttgatttttttcttagagattatttaaacagaatctataggcagtgtgtatataataaacatgtatggaaataaaactaaa
